United States Patent 7,745,391 (HUMAN THROMBOSPONDIN POLYPEPTIDE) - sequence listing, part 278

SEQ ID NO: 847299 - protein, 326 aa, Homo sapiens
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFLVSMMQMRRPGMEAHWLSRIFGWTPYWPGAQWGSWPVPKGGSNGFETVDCPEKYGAELAKRGGTILLGGPPSPRKGKTHHSKKHHLVV

SEQ ID NO: 847300 - protein, 246 aa, Homo sapiens; identical to SEQ ID NO: 847290

SEQ ID NO: 847301 - protein, 110 aa, Homo sapiens [sequence omitted]

SEQ ID NO: 847302 - protein, 158 aa, Homo sapiens; identical to SEQ ID NO: 847289

SEQ ID NO: 847303 - protein, 302 aa, Homo sapiens
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 847304 - protein, 661 aa, Homo sapiens
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLPARPTHQSELLLLRLVCLKPPRRKKPACRVQRQKRIMGSRAELCTLLGGFSFLLLLIPGEGAKGGSLRERLTTEGVGPGVSSSQEPSAGGGASQEAKHNCKFRMGVRGCHLEGERGASEPLEGSGTPGSPGPGLLNLSHLILWHGRSQGVCSKQTLVVPLHYNESYSQPVYKPYLTLCAGRRICSTYRTMYRVMWREVRREVQQTHAVCCQGWKKRHPGALTCEAICAKPCLNGGVCVRPDQCECAPGWGGKHCHVDVDECRTSITLCSHHCFNTAGSFTCGCPHDLVLGVDGRTCMEGSPEPPTSASILSVAVREAEKDERALKQEIHELRGRLERLEQWAGQAGAWVRAVLPVPPEELQPEQVAELWGRGDRIESLSDQVLLLEERLGACSCEDNSLGLGVNHR

SEQ ID NO: 847305 - protein, 107 aa, Homo sapiens
SRCEPPHLAYIITTILLLSTLTIAAASLLGFSPPVLPPFSASFSNCCLYPDPHHDDLYLNASSFLALINGERDHPNATVWRKNFLRVGHLVLIGGPDDGVITPWQSR

SEQ ID NO: 847306 - protein, 584 aa, Homo sapiens
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLPARPTHQSELLLLRLVCLKPPRRKKPACRVQRQKRIMGSRAELCTLLGGFSFLLLLIPGEGAKGGSLRESQGVCSKQTLVVPLHYNESYSQPVYKPYLTLCAGRRICSTYRTMYRVMWREVRREVQQTHAVCCQGWKKRHPGALTCEAICAKPCLNGGVCVRPDQCECAPGWGGKHCHVDVDECRTSITLCSHHCFNTAGSFTCGCPHDLVLGVDGRTCMEGSPEPPTSASILSVAVREAEKDERALKQEIHELRGRLERLEQWAGQAGAWVRAVLPVPPEELQPEQVAELWGRGDRIESLSDQVLLLEERLGACSCEDNSLGLGVNHR

SEQ ID NO: 847307 - protein, 535 aa, Homo sapiens; identical to SEQ ID NO: 847297

SEQ ID NO: 847308 - protein, 179 aa, Homo sapiens
MDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 847309 - protein, 270 aa, Homo sapiens
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 847310 - protein, 293 aa, Homo sapiens
MGSRAELCTLLGGFSFLLLLIPGEGAKGGSLRESQGVCSKQTLVVPLHYNESYSQPVYKPYLTLCAGRRICSTYRTMYRVMWREVRREVQQTHAVCCQGWKKRHPGALTCEAICAKPCLNGGVCVRPDQCECAPGWGGKHCHVDVDECRTSITLCSHHCFNTAGSFTCGCPHDLVLGVDGRTCMEGSPEPPTSASILSVAVREAEKDERALKQEIHELRGRLERLEQWAGQAGAWVRAVLPVPPEELQPEQVAELWGRGDRIESLSDQVLLLEERLGACSCEDNSLGLGVNHR

SEQ ID NO: 847311 - protein, 250 aa, Homo sapiens
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFLGSYVSNDTVLK

SEQ ID NO: 847312 - protein, 110 aa, Homo sapiens
NETVLEMEEQLVSPLGLLPLLAAVPPYSRALSVTPELKGSPCGEEVQDPSSNSLCLSLCLSSMLPRPFDHLEGLSAGFFWVEDSIGPGGHSEVSNGRYLPHSLALQPYPL

SEQ ID NO: 847313 - protein, 470 aa, Homo sapiens
MTPGLQHPPTVVQRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 847314 - protein, 453 aa, Homo sapiens
APRRQPFRGCLGQDELCDLGEVIFLLEPQWPHPSSGDERTCSGCLAEEHVDVNIFEKRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPRKKKGERFSIFILPKTLGPIPRLDNTDSFVPAGLVSSRPTHPSFRIVGTRDTPKGGNPPLKGGRDTHLANTTPLGSEQQQTHRRAEDARETDYTNTYLSILPTPSHTPTPIPILYNRGVLLRLRDTLPPPHTILVSEHQQQPPQTTTTTYSIHIRSPCTIARDTVDVHIAHTTPQLTTYRHIATIHYSTDEISYFIRSVASDRPYPRSNNSYTNTHHPNTSNHTADHP

SEQ ID NO: 847315 - protein, 483 aa, Homo sapiens
MAADEVAGGARKATKSKLFEFLVHGVRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 847316 - protein, 381 aa, Homo sapiens
MADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 847317 - protein, 457 aa, Homo sapiens
MTPGLQHPPTVVQRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 847318 - protein, 347 aa, Homo sapiens
MAADEVAGGARKATKSKLFEFLVHGVRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQVTSLLNPGIWGAGGVLQQGKYLYQGNYHPSLLDS

SEQ ID NO: 847319 - protein, 316 aa, Homo sapiens
MAADEVAGGARKATKSKLFEFLVHGVRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIPE

SEQ ID NO: 847320 - protein, 553 aa, Homo sapiens
MTPGLQHPPTVVQRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDVRPGPGLSRCPGVGMGCTENRTRCLHYGLGSQPRLGGGAGLETFQVQRISSKPTALSAANLASFCSSHLIPVSAPMVPVALPQPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 847321 - protein, 347 aa, Homo sapiens; identical to SEQ ID NO: 847318

SEQ ID NO: 847322 - protein, 409 aa, Homo sapiens
MTPGLQHPPTVVQRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPRKKKGERFSIFILPKTLGPIPRLDNTDSFVPAGLVSSRPTHPSFRIVGTRDTPKGGNPPLKGGRDTHLANTTPLGSEQQQTHRRAEDARETDYTNTYLSILPTPSHTPTPIPILYNRGVLLRLRDTLPPPHTILVSEHQQQPPQTTTTTYSIHIRSPCTIARDTVDVHIAHTTPQLTTYRHIATIHYRRTEISYFIRSVASDRPYPRSNNSYTNTHHPNTSNHTADHP

SEQ ID NO: 847323 - protein, 470 aa, Homo sapiens; identical to SEQ ID NO: 847313

SEQ ID NO: 847324 - protein, 296 aa, Homo sapiens
MAADEVAGGARKATKSKLFEFLVHGVRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGVATSVTLPPCVLTPLDPPLFGP

SEQ ID NO: 847325 - protein, 470 aa, Homo sapiens; identical to SEQ ID NO: 847313

SEQ ID NO: 847326 - protein, 518 aa, Homo sapiens
EGRQQHPHVTDEDRAPGRKRHSPGHMARHEQIPSRPEATRLPPRSLAANIWMQPASVEDGKRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 847327 - protein, 470 aa, Homo sapiens
MAADEVAGGARKATKSKLFEFLVHGVRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 847328 - protein, 347 aa, Homo sapiens; identical to SEQ ID NO: 847318

SEQ ID NO: 847329 - protein, 402 aa, Homo sapiens
MAADEVAGGARKATKSKLFEFLVHGVRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKVGPKPRAGVGH

SEQ ID NO: 847330 - protein, 204 aa, Homo sapiens
TEGRGRTAGAGVGARGADPRQGNHKGTSTQQIRPIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 847331 - protein, 78 aa, Homo sapiens
AFARFCTLFLQQKRKLRLYISNTFNPAKPDAEDSDGSIASWELRVEGKLLDDVRPGPGLSRCPGVGMGCTENRTRCLH

SEQ ID NO: 847332 - protein, 188 aa, Homo sapiens
ISEDPRGLANIITRGVKYDALSLLKLRKLDDAIEDCTNAVKLDDTYIKAYFEKSSVVSASDGEGEEGVAAGLRGIALWMTKQTQRCGEVIWSFPLPLGGIVPALDYLYRPPAEEIAQAPSVSQCLCLTPLTVSKFPLMGEDWPSCSPVRPQHGDHLLMTMPTCIFFSFMAFIITMNIWLTAISPTSLV

SEQ ID NO: 847333 - protein, 166 aa, Homo sapiens
MAQPQDSSHAPGVSGSQPFSPATFLPCRSHSPAHLLRSLQGQVKADNPTGKCLVATLLEEGHAPSPHTPTGAHDKPACASHDSHPKHAGRDKLKGKEKSAVLQLWGDRARESATRQRSSSPCPFQEEDIPSCSLYKAAAETGSPVCRGGRGSGLGWFLLFFKCRGV

SEQ ID NO: 847334 - protein, 389 aa, Homo sapiens
MEFPLAQICPQGSHEAPIPTFSTFQITDMTRRSCQNLGYTAASPQAPEAASSTGNAERAEEVPGEGSLFLQAETRAWFQKTQAHWLLQHGAAPAWFHGFITRREAERLLEPKPQGCYLVRFSESAVTFVLTYRSRTCCRHFLLAQLRDGRHVVLGEDSAHARLQDLLLHYTAHPLSPYGETLTEPLARQTPEPAGLSLRTEESNFGSKSQDPNPQYSPIIKQGQAPVPMQKEGAGEKEPSQLLRPKPPIPAKPQLPPEVYTIPVPRHRPAPRPKPSNPIYNEPDEPIAFYAMGRGSPGEAPSNIYVEVEDEGLPATLGHPVLRKSWSRPVPGGQNTGGSQLHSENSVIGQGPPLPHQPPPAWRHTLPHNLSRQVLQDRGQAWLPLGPPQ

SEQ ID NO: 847335 - protein, 371 aa, Homo sapiens [sequence omitted]

SEQ ID NO: 847336 - protein, 308 aa, Homo sapiens
GRQRRGWKCQSRVRPPLSVTHREAERLLEPKPQGCYLVRFSESAVTFVLTYRSRTCCRHFLLAQLRDGRHVVLGEDSAHARLQDLLLHYTAHPLSPYGETLTEPLARQTPEPAGLSLRTEESNFGSKSQDPNPQYSPIIKQGQAPVPMQKEGAGEKEPSQLLRPKPPIPAKPQLPPEVYTIPVPRHRPAPRPKPSNPIYNEPDEPIAFYAMGRGSPGEAPSNIYVEVEDEGLPATLGHPVLRKSWSRPVPGGQNTGGSQLHSENSVIGQGPPLPHQPPPAWRHTLPHNLSRQVLQDRGQAWLPLGPPQ

SEQ ID NO: 847337 - protein, 275 aa, Homo sapiens
MSPSTFQITDMTRRSCQNLGYTAASPQAPEAASSTGNAERAEEVPGEGSLFLQAETRAWFQKTQAHWLLQHGAAPAWFHGFITRREAERLLEPKPQGCYLVRFSESAVTFVLTYRSRTCCRHFLLAQLRDGRHVVLGEDSAHARLQDLLLHYTAHPLSPYGETLTEPLARQTPEPAGLSLRTEESNFGSKSQDPNPQYSPIIKQGQAPVPMQKEGAGEKENTGGSQLHSENSVIGQGPPLPHQPPPAWRHTLPHNLSRQVLQDRGQAWLPLGPPQ

SEQ ID NO: 847338 - protein, 103 aa, Homo sapiens
MEFPLAQICPQGSHEAPIPTFSTFQITDMTRRSCQNLGYTAASPQAPEAASSTGNAERAEEVPGEGSLFLQAETRAWFQKTQAHWLLQHGAAPAWFHGFITRR

SEQ ID NO: 847339 - protein, 371 aa, Homo sapiens [sequence omitted]

SEQ ID NO: 847340 - protein, 280 aa, Homo sapiens
GSRLSLVTLAEEREIVCSLTAPSRSRTCCRHFLLAQLRDGRHVVLGEDSAHARLQDLLLHYTAHPLSPYGETLTEPLARQTPEPAGLSLRTEESNFGSKSQDPNPQYSPIIKQGQAPVPMQKEGAGEKEPSQLLRPKPPIPAKPQLPPEVYTIPVPRHRPAPRPKPSNPIYNEPDEPIAFYAMGRGSPGEAPSNIYVEVEDEGLPATLGHPVLRKSWSRPVPGGQNTGGSQLHSENSVIGQGPPLPHQPPPAWRHTLPHNLSRQVLQDRGQAWLPLGPPQ

SEQ ID NO: 847341 - protein, 371 aa, Homo sapiens [sequence omitted]

SEQ ID NO: 847342 - protein, 1068 aa, Homo sapiens
MSRQSTLYSFFPKSPALSDANKASARASREGGRAAAAPGASPSPGGDAAWSEAGPGPRPLARSASPPKAKNLNGGLRRSVAPAAPTSCDFSPGDLVWAKMEGYPWWPCLVYNHPFDGTFIREKGKSVRVHVQFFDDSPTRGWVIKRLLKPYTGSKSKEAQKGGHFYSAKPEILRAMQRADEALNKDKIKRLELAVCDEPSEPEEEEEMEVGTTYVTDKSEEDNEIESEEEVQPKTQGSRRSSRQIKKRRVISDSESDIGGSDVEFKPDTKEEGSSDEISSGVGDSESEGLNSPVKVARKRKRMVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLGKTLNKLVLRL

SEQ ID NO: 847343 - protein, 121 aa, Homo sapiens
MSRQSTLYSFFPKSPALSDANKASARASREGGRAAAAPGASPSPGGDAAWSEAGPGPRPLARSASPPKAKNLNGGLRRSVAPAAPTREFRSSPGWSAMARSQLTAISASRLQAIPQLQPPE

SEQ ID NO: 847344 - protein, 1261 aa, Homo sapiens
MEGYPWWPCLVYNHPFDGTFIREKGKSVRVHVQFFDDSPTRGWVIKRLLKPYTGSKSKEAQKGGHFYSAKPEILRAMQRADEALNKDKIKRLELAVCDEPSEPEEEEEMEVGTTYVTDKSEEDNEIESEEEVQPKTQGSRRSSRQIKKRRVISDSESDIGGSDVEFKPDTKEEGSSDEISSGVGDSESEGLNSPVKVARKRKRMVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLDVLLCLANYSRGGDGPMCRPVILLPEDTPPFLELKGSRHPCITKTFFGDDFIPNDILIGCEEEEQENGKAYCVLVTGPNMGGKSTLMRQAGLLAVMAQMGCYVPAEVCRLTPIDRVFTRLGASDRIMSGESTFFVELSETASILMHATAHSLVLVDELGRGTATFDGTAIANAVVKELAETIKCRTLFSTHYHSLVEDYSQNVAVRLGHMACMVENECEDPSQETITFLYKFIKGACPKSYGFNAARLANLPEEVIQKGHRKAREFEKMNQSLRLFREVCLASERSTVDAEAVHKLLTLIKEL

SEQ ID NO: 847345 - protein, 1185 aa, Homo sapiens
MQRADEALNKDKIKRLELAVCDEPSEPEEEEEMEVGTTYVTDKSEEDNEIESEEEVQPKTQGSRRSSRQIKKRRVISDSESDIGGSDVEFKPDTKEEGSSDEISSGVGDSESEGLNSPVKVARKRKRMVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLDVLLCLANYSRGGDGPMCRPVILLPEDTPPFLELKGSRHPCITKTFFGDDFIPNDILIGCEEEEQENGKAYCVLVTGPNMGGKSTLMRQAGLLAVMAQMGCYVPAEVCRLTPIDRVFTRLGASDRIMSGESTFFVELSETASILMHATAHSLVLVDELGRGTATFDGTAIANAVVKELAETIKCRTLFSTHYHSLVEDYSQNVAVRLGHMACMVENECEDPSQETITFLYKFIKGACPKSYGFNAARLANLPEEVIQKGHRKAREFEKMNQSLRLFREVCLASERSTVDAEAVHKLLTLIKEL

SEQ ID NO: 847346 - protein, 666 aa, Homo sapiens
MSLHLHHSLIGFGEDSTRSCSADCVRIQGNIFFKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLDVLLCLANYSRGGDGPMCRPVILLPEDTPPFLELKGSRHPCITKTFFGDDFIPNDILIGCEEEEQENGKAYCVLVTGPNMGGKSTLMRQAGLLAVMAQMGCYVPAEVCRLTPIDRVFTRLGASDRIMSGESTFFVELSETASILMHATAHSLVLVDELGRGTATFDGTAIANAVVKELAETIKCRTLFSTHYHSLVEDYSQNVAVRLGHMACMVENECEDPSQETITFLYKFIKGACPKSYGFNAARLANLPEEVIQKGHRKAREFEKMNQSLRLFREVCLASERSTVDAEAVHKLLTLIKEL

SEQ ID NO: 847347 - protein, 1150 aa, Homo sapiens
MSRQSTLYSFFPKSPALSDANKASARASREGGRAAAAPGASPSPGGDAAWSEAGPGPRPLARSASPPKAKNLNGGLRRSVAPAAPTSCDFSPGDLVWAKMEGYPWWPCLVYNHPFDGTFIREKGKSVRVHVQFFDDSPTRGWVIKRLLKPYTGSKSKEAQKGGHFYSAKPEILRAMQRADEALNKDKIKRLELAVCDEPSEPEEEEEMEVGTTYVTDKSEEDNEIESEEEVQPKTQGSRRSSRQIKKRRVISDSESDIGGSDVEFKPDTKEEGSSDEISSGVGDSESEGLNSPVKVARKRKRMVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLDVLLCLANYSRGGDGPMCRPVILLPEDTPPFLELKGSRHPCITKTFFGDDFIPNDILIGCEEEEQENGKAYCVLVTGPNMGGKSTLMRQVTDS

SEQ ID NO: 847348 - protein, 1126 aa, Homo sapiens
MSRQSTLYSFFPKSPALSDANKASARASREGGRAAAAPGASPSPGGDAAWSEAGPGPRPLARSASPPKAKNLNGGLRRSVAPAAPTSCDFSPGDLVWAKMEGYPWWPCLVYNHPFDGTFIREKGKSVRVHVQFFDDSPTRGWVIKRLLKPYTGSKSKEAQKGGHFYSAKPEILRAMQRADEALNKDKIKRLELAVCDEPSEPEEEEEMEVGTTYVTDKSEEDNEIESEEEVQPKTQGSRRSSRQIKKRRVISDSESDIGGSDVEFKPDTKEEGSSDEISSGVGDSESEGLNSPVKVARKRKRMVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLDVLLCLANYSRGGDGPMCRPVILLTSRKAFSNFKPVLRQETSNTFLQSLNAPVPFTGSEQGMKFSLELL

SEQ ID NO: 847349 - protein, 159 aa, Homo sapiens [sequence omitted]

SEQ ID NO: 847350 - protein, 1360 aa, Homo sapiens
MSRQSTLYSFFPKSPALSDANKASARASREGGRAAAAPGASPSPGGDAAWSEAGPGPRPLARSASPPKAKNLNGGLRRSVAPAAPTSCDFSPGDLVWAKMEGYPWWPCLVYNHPFDGTFIREKGKSVRVHVQFFDDSPTRGWVIKRLLKPYTGSKSKEAQKGGHFYSAKPEILRAMQRADEALNKDKIKRLELAVCDEPSEPEEEEEMEVGTTYVTDKSEEDNEIESEEEVQPKTQGSRRSSRQIKKRRVISDSESDIGGSDVEFKPDTKEEGSSDEISSGVGDSESEGLNSPVKVARKRKRMVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLDVLLCLANYSRGGDGPMCRPVILLPEDTPPFLELKGSRHPCITKTFFGDDFIPNDILIGCEEEEQENGKAYCVLVTGPNMGGKSTLMRQAGLLAVMAQMGCYVPAEVCRLTPIDRVFTRLGASDRIMSGESTFFVELSETASILMHATAHSLVLVDELGRGTATFDGTAIANAVVKELAETIKCRTLFSTHYHSLVEDYSQNVAVRLGHMACMVENECEDPSQETITFLYKFIKGACPKSYGFNAARLANLPEEVIQKGHRKAREFEKMNQSLRLFREVCLASERSTVDAEAVHKLLTLIKEL

SEQ ID NO: 847351 - protein, 191 aa, Homo sapiens
MSRQSTLYSFFPKSPALSDANKASARASREGGRAAAAPGASPSPGGDAAWSEAGPGPRPLARSASPPKAKNLNGGLRRSVAPAAPTSCDFSPGDLVWAKMEGYPWWPCLVYNHPFDGTFIREKGKSVRVHVQFFDDSPTRGWVIKRLLKPYTGKSHYCHVCVFVCVCVCVRETDRQADFFLYDEIKCILPQ

SEQ ID NO: 847352 - protein, 1261 aa, Homo sapiens; identical to SEQ ID NO: 847344

SEQ ID NO: 847353 - protein, 1360 aa, Homo sapiens; identical to SEQ ID NO: 847350

SEQ ID NO: 847354 - protein, 1358 aa, Homo sapiens
MSRQSTLYSFFPKSPALSDANKASARASREGGRAAAAPGASPSPGGDAAWSEAGPGPRPLARSASPPKAKNLNGGLRRSVAPAAPTSCDFSPGDLVWAKMEGYPWWPCLVYNHPFDGTFIREKGKSVRVHVQFFDDSPTRGWVIKRLLKPYTGSKSKEAQKGGHFYSAKPEILRAMQRADEALNKDKIKRLELAVCDEPSEPEEEEEMEVGTTYVTDKSEEDNEIESEEEVQPKTQGSRRSSRQIKKRRVISDSESDIGGSDVEFKPDTKEEGSSDEISSGVGDSESEGLNSPVKVARKRKRMVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLDVLLCLANYSRGGDGPMCRPVILLPEDTPPFLELKGSRHPCITKTFFGDDFIPNDILIGCEEEEQENGKAYCVLVTGPNMGGKSTLMRQAGLLAVMAQMGCYVPAEVCRLTPIDRVFTRLGASDRIMSGESTFFVELSETASILMHATAHSLVLVDELGRGTATFDGTAIANAVVKELAETIKCRTLFSTHYHSLVEDYSQNVAVRLGHMACMVENECEDPSQETITFLYKFIKGACPKSYGFNAARLANLPEEVIQKGHRKKKKKKKKRNINLEKKLDDEDKKVKFKRKIIDMTTLEALS

SEQ ID NO: 847355 - protein, 387 aa, Homo sapiens
QSSSFTALLGRFQLVFFWQIASGEILKKGCKRYWTKTIEKKLANLINAEERRDVSLKDCMRRLFYNFDKNYKDWQSAVECIAVLDVLLCLANYSRGGDGPMCRPVILLPEDTPPFLELKGSRHPCITKTFFGDDFIPNDILIGCEEEEQENGKAYCVLVTGPNMGGKSTLMRQAGLLAVMAQMGCYVPAEVCRLTPIDRVFTRLGASDRIMSGESTFFVELSETASILMHATAHSLVLVDELGRGTATFDGTAIANAVVKELAETIKCRTLFSTHYHSLVEDYSQNVAVRLGHMACMVENECEDPSQETITFLYKFIKGACPKSYGFNAARLANLPEEVIQKGHRKAREFEKMNQSLRLFREVCLASERSTVDAEAVHKLLTLIKEL

SEQ ID NO: 847356 - protein, 86 aa, Homo sapiens
GGGKPRNLLPEVRRPSPKSVGSASKLEGLVSAPLPGGGGHLRCVQLRALAGLAPRLGWSAAPHLPGSDPEPFPAGRGPPNNRLLSR

SEQ ID NO: 847357 - protein, 152 aa, Homo sapiens
MASSLNEDPEGSRITYVKGDLFACPKTDSLAHCISEDCRMGAGIAVLFKKKFGGVQELLNQQKKSGEVAVLKRDGRYIYYLITKKRASHKPTYENLQKSLEAMKSHCLKNGVTDLSMPRIGCGLDRLQWENVSAMIEEVFEATDIKITVYTL

SEQ ID NO: 847358 - protein, 152 aa, Homo sapiens; identical to SEQ ID NO: 847357

SEQ ID NO: 847359 - protein, 152 aa, Homo sapiens; identical to SEQ ID NO: 847357

SEQ ID NO: 847360 - protein, 86 aa, Homo sapiens; identical to SEQ ID NO: 847356

SEQ ID NO: 847361 - protein, 86 aa, Homo sapiens; identical to SEQ ID NO: 847356

SEQ ID NO: 847362 - protein, 86 aa, Homo sapiens; identical to SEQ ID NO: 847356

SEQ ID NO: 847363 - protein, 86 aa, Homo sapiens; identical to SEQ ID NO: 847356

SEQ ID NO: 847364 - protein, 69 aa, Homo sapiens
AQKRPSQLIVTPASASDPPSLDLKAQVTFLITTRSRIGCGLDRLQWENVSAMIEEVFEATDIKITVYTL

SEQ ID NO: 847365 - protein, 152 aa, Homo sapiens; identical to SEQ ID NO: 847357

SEQ ID NO: 847366 - protein, 86 aa, Homo sapiens; identical to SEQ ID NO: 847356

SEQ ID NO: 847367 - protein, 86 aa, Homo sapiens; identical to SEQ ID NO: 847356

SEQ ID NO: 847368 - protein, 118 aa, Homo sapiens
MRKGINLLRVRFQAPNGLVLQPGQETETAWLGSKTEVCGPATANGAGKRGNDEPKGVVTAPGRRPGRSGLGGGARRSRGSGRTNGPLSPPGRQRGRAHRAPRRGRASPVASRTRDPAA

SEQ ID NO: 847369 - protein, 152 aa, Homo sapiens; identical to SEQ ID NO: 847357

SEQ ID NO: 847370 - protein, 152 aa, Homo sapiens; identical to SEQ ID NO: 847357

SEQ ID NO: 847371 - protein, 152 aa, Homo sapiens; identical to SEQ ID NO: 847357

SEQ ID NO: 847372 - protein, 86 aa, Homo sapiens; identical to SEQ ID NO: 847356

SEQ ID NO: 847373 - protein, 86 aa, Homo sapiens; identical to SEQ ID NO: 847356

SEQ ID NO: 847374 - protein, 152 aa, Homo sapiens; identical to SEQ ID NO: 847357

SEQ ID NO: 847375 - protein, 517 aa, Homo sapiens
MASGPGSQEREGLLIVKLEEDCAWSQELPPPDPGPSPEASHLRFRRFRFQEAAGPREALSRLQELCHGWLRPEMRTKEQILELLVLEQFLTILPQEIQSRVQELHPESGEEAVTLVEDMQRELGRLRQQEKRNLRTWKVFRLYALRTSTLRCCFLTRPEGRCPGVLSWEDLMTGRKGIGRLPQRVEWSRPWQEPQVAENWGDRRNCSQRNSIYVTLCGKNFSNNSNLIRHQRIHAAERLCMGVDCTEIFGGNPRFLSLHRAHLGEEAHKCLECGKCFSQNTHLTRHQRTHTGEKPYQCNICGKCFSCNSNLHRHQRTHTGEKPYKCPECGEIFAHSSNLLRHQRIHTGERPYKCPECGKSFSRSSHLVIHERTHERERLYPFSECGEAVSDSTPFLTNHGAHKAEKKLFECLTCGKSFRQGMHLTRHQRTHTGEKPYKCTLCGENFSHRSNLIRHQRIHTGEKPYTCHECGDSFSHSSNRIRHLRTHTGERPYKCSECGESFSRSSRLMSHQRTHTG

SEQ ID NO: 847376 - protein, 556 aa, Homo sapiens
MASGPGSQEREGLLIVKLEEDCAWSQELPPPDPGPSPEASHLRFRRFRFQEAAGPREALSRLQELCHGWLRPEMRTKEQILELLVLEQFLTILPQEIQSRVQELHPESGEEAVTLVEDMQRELGRLRQQSLTFPVRRSQAPRWDKEESYGIPVSRAAEEGLSPRGPAPGEEKFENLEGVPSVCSENIHPQVLLPDQARGEVPWSPELGRPHDRSQGDWAPPPEGGMEQALAGASSGRELGRPKELQPKKLHLCPLCGKNFSNNSNLIRHQRIHAAERLCMGVDCTEIFGGNPRFLSLHRAHLGEEAHKCLECGKCFSQNTHLTRHQRTHTGEKPYQCNICGKCFSCNSNLHRHQRTHTGEKPYKCPECGEIFAHSSNLLRHQRIHTGERPYKCPECGKSFSRSSHLVIHERTHERERLYPFSECGEAVSDSTPFLTNHGAHKAEKKLFECLTCGKSFRQGMHLTRHQRTHTGEKPYKCTLCGENFSHRSNLIRHQRIHTGEKPYTCHECGDSFSHSSNRIRHLRTHTGERPYKCSECGESFSRSSRLMSHQRTHTG

SEQ ID NO: 847377 - protein, 683 aa, Homo sapiens
MASGPGSQEREGLLIVKLEEDCAWSQELPPPDPGPSPEASHLRFRRFRFQEAAGPREALSRLQELCHGWLRPEMRTKEQILELLVLEQFLTILPQEIQSRVQELHPESGEEAVTLVEDMQRELGRLRQQVTNHGRGTEVLLEEPLPLETARESPSFKLEPMETERSPGPRLQELLGPSPQRDPQAVKERALSAPWLSLFPPEGNMEDKEMTGPQLPESLEDVAMYISQEEWGHQDPSKRALSRDTVQESYENVDSLESHIPSQEVPGTQVGQGGKLWDPSVQSCKEGLSPRGPAPGEEKFENLEGVPSVCSENIHPQVLLPDQARGEVPWSPELGRPHDRSQGDWAPPPEGGMEQALAGASSGRELGRPKELQPKKLHLCPLCGKNFSNNSNLIRHQRIHAAERLCMGVDCTEIFGGNPRFLSLHRAHLGEEAHKCLECGKCFSQNTHLTRHQRTHTGEKPYQCNICGKCFSCNSNLHRHQRTHTGEKPYKCPECGEIFAHSSNLLRHQRIHTGERPYKCPECGKSFSRSSHLVIHERTHERERLYPFSECGEAVSDSTPFLTNHGAHKAEKKLFECLTCGKSFRQGMHLTRHQRTHTGEKPYKCTLCGENFSHRSNLIRHQRIHTGEKPYTCHECGDSFSHSSNRIRHLRTHTGERPYKCSECGESFSRSSRLMSHQRTHTG

SEQ ID NO: 847378 - protein, 683 aa, Homo sapiens; identical to SEQ ID NO: 847377

SEQ ID NO: 847379 - protein, 681 aa, Homo sapiens
MASGPGSQEREGLLIVKLEEDCAWSQELPPPDPGPSPEASHLRFRRFRFQEAAGPREALSRLQELCHGWLRPEMRTKEQILELLVLEQFLTILPQEIQSRVQELHPESGEEAVTLVEDMQRELGRLRQQVTNHGRGTEVLLEEPLPLETARESPSFKLEPMETERSPGPRLQELLGPSPQRDPQAVKERALSAPWLSLFPPEGNMEDKEMTGPQLPESLEDVAMYISQEEWGHQDPSKRALSRDTVQESYENVDSLESHIPSQEVPGTQVGQGGKLWDPSVQSCKEGLSPRGPAPGEEKFENLEGVPSVCSENIHPQVLLPDQARGEVPWSPELGRPHDRSQGDWAPPPEGGMEQALAGASSGRELGRPKELQPKKLHLCPLCGKNFSNNSNLIRHQRIHAAERLCMGVDCTEIFGGNPRFLSLHRAHLGEEAHKCLECGKCFSQNTHLTRHQRTHTGEKPYQCNICGKCFSCNSNLHRHQRTHTGEKPYKCPECGEIFAHSSNLLRHQRIHTGERPYKCPECGKSFSRSSHLVIHERTHERERLYPFSECGEAVSDSTPFLTNHGAHKAEKKLFECLTCGKSFRQGMHLTRHQRTHTGEKPYKCTLCGENFSHRSNLIRHQRIHTGEKPYTCHECGDSFSHSSNRIRHLRTHTGERPYKCSECGESFSRSSRLMSHQRTL

SEQ ID NO: 847380 - protein, 618 aa, Homo sapiens
MASGPGSQEREGLLIVKLEEDCAWSQELPPPDPGPSPEASHLRFRRFRFQEAAGPREALSRLQELCHGWLRPEMRTKEQILELLVLEQFLTILPQEIQSRVQELHPESGEEAVTLVEDMQRELGRLRQQVTNHGRGTEVLLEEPLPLETARESPSFKLEPMETERSPGPRLQELLGPSPQRDPQAVKERALSAPWLSLFPPEGNMEDKEMTGPQLPESLEDVAMYISQEEWGHQDPSKRALSRDTVQESYENVDSLESHIPSQEVPGTQVGQGGKLWDPSVQSCKEGLSPRGPAPGEEKFENLEGVPSVCSENIHPQVLLPDQARGEVPWSPELGRPHDRSQGDWAPPPEGGMEQALAGASSGRELGRPKELQPKKLHLCPLCGKNFSNNSNLIRHQRIHAAERLCMGVDCTEIFGGNPRFLSLHRAHLGEEAHKCLECGKCFSQNTHLTRHQRTHTGEKPYQCNICGKCFSCNSNLHRHQRTHTGEKPYKCPECGEIFAHSSNLLRHQRIHTGERPYKCPECGKSFSRSSHLVIHERTHERERLYPFSECGEAVSDSTPFLTNHGAHKAEKKLFECLTCGKSFRQGMHLTRHQRTHTGEKPYKSDNPLWRMRFPPPV

SEQ ID NO: 847381 - protein, 681 aa, Homo sapiens; identical to SEQ ID NO: 847379

SEQ ID NO: 847382 - protein, 683 aa, Homo sapiens; identical to SEQ ID NO: 847377

SEQ ID NO: 847383 - protein, 598 aa, Homo sapiens
MASGPGSQEREGLLIVKLEEDCAWSQELPPPDPGPSPEASHLRFRRFRFQEAAGPREALSRLQELCHGWLRPEMRTKEQILELLVLEQFLTILPQEIQSRVQELHPESGEEAVTLVEDMQRELGRLRQQLPESLEDVAMYISQEEWGHQDPSKRALSRDTVQESYENVDSLESHIPSQEVPGTQVGQGGKLWDPSVQSCKEGLSPRGPAPGEEKFENLEGVPSVCSENIHPQVLLPDQARGEVPWSPELGRPHDRSQGDWAPPPEGGMEQALAGASSGRELGRPKELQPKKLHLCPLCGKNFSNNSNLIRHQRIHAAERLCMGVDCTEIFGGNPRFLSLHRAHLGEEAHKCLECGKCFSQNTHLTRHQRTHTGEKPYQCNICGKCFSCNSNLHRHQRTHTGEKPYKCPECGEIFAHSSNLLRHQRIHTGERPYKCPECGKSFSRSSHLVIHERTHERERLYPFSECGEAVSDSTPFLTNHGAHKAEKKLFECLTCGKSFRQGMHLTRHQRTHTGEKPYKCTLCGENFSHRSNLIRHQRIHTGEKPYTCHECGDSFSHSSNRIRHLRTHTGERPYKCSECGESFSRSSRLMSHQRTHTG

SEQ ID NO: 847384 - protein, 683 aa, Homo sapiens; identical to SEQ ID NO: 847377

SEQ ID NO: 847385 - protein, 683 aa, Homo sapiens; identical to SEQ ID NO: 847377

SEQ ID NO: 847386 - protein, 681 aa, Homo sapiens; identical to SEQ ID NO: 847379

SEQ ID NO: 847387 - protein, 694 aa, Homo sapiens
MASGPGSQEREGLLIVKLEEDCAWSQELPPPDPGPSPEASHLRFRRFRFQEAAGPREALSRLQELCHGWLRPEMRTKEQILELLVLEQFLTILPQEIQSRVQELHPESGEEAVTLVEDMQRELGRLRQQVTNHGRGTEVLLEEPLPLETARESPSFKLEPMETERSPGPRLQELLGPSPQRDPQAVKERALSAPWLSLFPPEGNMEDKEMTGPQLPESLEDVAMYISQEEWGHQDPSKRALSRDTVQESYENVDSLESHIPSQEVPGTQVGQGGKLWDPSVQSCKEGLSPRGPAPGEEKFENLEGVPSVCSENIHPQVLLPDQARGEVPWSPELGRPHDRSQGDWAPPPEGGMEQALAGASSGRELGRPKELQPKKLHLCPLCGKNFSNNSNLIRHQRIHAAERLCMGVDCTEIFGGNPRFLSLHRAHLGEEAHKCLECGKCFSQNTHLTRHQRTHTGEKPYQCNICGKCFSCNSNLHRHQRTHTGEKPYKCPECGEIFAHSSNLLRHQRIHTGERPYKCPECGKSFSRSSHLVIHERTHERERLYPFSECGEAVSDSTPFLTNHGAHKAEKKLFECLTCGKSFRQGMHLTRHQRTHTGEKPYKCTLCGENFSHRSNLIRHQRIHTGEKPYTCHECGDSFSHSSNRIRHLRTHTGERPYKCSECGESFSRSSRLMSHQRTPDNPLWRMRFPPPV

SEQ ID NO: 847388 - protein, 772 aa, Homo sapiens
MAEAHQAVAFQFTVTPDGVDFRLSREALKHVYLSGINSWKKRLIRIKNGILRGVYPGSPTSWLVVIMATVGSSFCNVDISLGLVSCIQRCLPQGCGPYQTPQTRALLSMAIFSTGVWVTGIFFFRQTLKLLLCYHGWMFEMHGKTSNLTRIWAMCIRLLSSRHPMLYSFQTSLPKLPVPRVSATIQRYLESVRPLLDDEEYYRMELLAKEFQDKTAPRLQKYLVLKSWWASNYVSDWWEEYIYLRGRSPLMVNSNYYVMDLVLIKNTDVQAARLGNIIHAMIMYRRKLDREEIKPVMALGIVPMCSYQMERMFNTTRIPGKDTDVLQHLSDSRHVAVYHKGRFFKLWLYEGARLLKPQDLEMQFQRILDDPSPPQPGEEKLAALTAGGRVEWAQARQAFFSSGKNKAALEAIERAAFFVALDEESYSYDPEDEASLSLYGKALLHGNCYNRWFDKSFTLISFKNGQLGLNAEHAWADAPIIGHLWEFVLGTDSFHLGYTETGHCLGKPNPALAPPTRLQWDIPKQCQAVIESSYQVAKALADDVELYCFQFLPFGKGLIKKCRTSPDAFVQIALQLAHFRDRGKFCLTYEASMTRMFREGRTETVRSCTSESTAFVQAMMEGSHTKADLRDLFQKAAKKHQNMYRLAMTGAGIDRHLFCLYLVSKYLGVSSPFLAEVLSEPWRLSTSQIPQSQIRMFDPEQHPNHLGAGGGFGPVADDGYGVSYMIAGENTIFFHISSKFSSSETNAQRFGNHIRKALLDIADLFQVPKAYS

SEQ ID NO: 847389 - protein, 227 aa, Homo sapiens
GLAGGAGRGQPLVAGWGARGVADWLGASRRGWRRGRPKRARAPICPRPRCRPTPRMAEAHQAVAFQFTVTPDGVDFRLSREALKHVYLSGINSWKKRLIRIKNGILRGVYPGSPTSWLVVIMATVGSSFCNVDISLGLVSCIQRCLPQGCGPYQTPQTRALLSMAIFSTGVWVTGIFFFRQTLKLLLCYHGWMFEMHGKTSNLTRIWAVSSSQWRGSGTWVETLWTP

SEQ ID NO: 847390 - protein, 395 aa, Homo sapiens; identical to SEQ ID NO: 847046

SEQ ID NO: 847391 - protein, 772 aa, Homo sapiens; identical to SEQ ID NO: 847388

SEQ ID NO: 847392 - protein, 772 aa, Homo sapiens; identical to SEQ ID NO: 847388

SEQ ID NO: 847393 - protein, 772 aa, Homo sapiens; identical to SEQ ID NO: 847388

SEQ ID NO: 847394 - protein, 772 aa, Homo sapiens; identical to SEQ ID NO: 847388

SEQ ID NO: 847395 - protein, 799 aa, Homo sapiens
MAEAHQAVAFQFTVTPDGVDFRLSREALKHVYLSGINSWKKRLIRIKNGILRGVYPGSPTSWLVVIMATVGSSFCNVDISLGLVSCIQRCLPQGCGPYQTPQTRALLSMAIFSTGVWVTGIFFFRQTLKLLLCYHGWMFEMHGKTSNLTRIWAMCIRLLSSRHPMLYSFQTSLPKLPVPRVSATIQRYLESVRPLLDDEEYYRMELLAKEFQDKTAPRLQKYLVLKSWWASNYVSDWWEEYIYLRGRSPLMVNSNYYVMDLVLIKNTDVQAARLGNIIHAMIMYRRKLDREEIKPVMALGIVPMCSYQMERMFNTTRIPGKDTDVLQHLSDSRHVAVYHKGRFFKLWLYEGARLLKPQDLEMQFQRILDDPSPPQPGEEKLAALTAGGRVEWAQARQAFFSSGKNKAALEAIERAAFFVALDEESYSYDPEDEASLSLYGKALLHGNCYNRWFDKSFTLISFKNGQLGLNAEHAWADAPIIGHLWEFVLGTDSFHLGYTETGHCLGKPNPALAPPTRLQWDIPKQCQAVIESSYQVAKALADDVELYCFQFLPFGKGLIKKCRTSPDAFVQIALQLAHFRVGAPPPAAERAGGTRVHLPDSPLCISQDRGKFCLTYEASMTRMFREGRTETVRSCTSESTAFVQAMMEGSHTKADLRDLFQKAAKKHQNMYRLAMTGAGIDRHLFCLYLVSKYLGVSSPFLAEVLSEPWRLSTSQIPQSQIRMFDPEQHPNHLGAGGGFGPVADDGYGVSYMIAGENTIFFHISSKFSSSETNAQRFGNHIRKALLDIADLFQVPKAYS

SEQ ID NO: 847396 - protein, 772 aa, Homo sapiens; identical to SEQ ID NO: 847388

SEQ ID NO: 847397 - protein, 721 aa, Homo sapiens
MAEAHQAVAFQFTVTPDGVDFRLSREALKHVYLSGINSWKKRLIRIKNGILRGVYPGSPTSWLVVIMATVGSSFCNVDISLGLVSCIQRCLPQGCGPYQTPQTRALLSMAIFSTGVWVTGIFFFRQTLKLLLCYHGWMFEMHGKTSNLTRIWAMCIRLLSSRHPMLYSFQTSLPKLPVPRVSATIQRYLESVRPLLDDEEYYRMELLAKEFQDKTAPRLQKYLVLKSWWASNYVSDWWEEYIYLRGRSPLMVNSNYYVMDLVLIKNTDVQAARLGNIIHAMIMYRRKLDREEIKPVMALGIVPMCSYQMERMFNTTRIPGKDTDVLQHLSDSRHVAVYHKGRFFKLWLYEGARLLKPQDLEMQFQRILDDPSPPQPGEEKLAALTAGGRVEWAQARQAFFSSGKNKAALEAIERAAFFVALDEESYSYDPEDEASLSLYGKALLHGNCYNRWFDKSFTLISFKNGQLGLNAEHAWADAPIIGHLWEFVLGTDSFHLGYTETGHCLGKPNPALAPPTRLQWDIPKQCQAVIESSYQVAKALADDVELYCFQFLPFGKGLIKKCRTSPDAFVQIALQLAHFRDRGKFCLTYEASMTRMFREGRTETVRSCTSESTAFVQAMMEGSHTKADLRDLFQKAAKKHQNMYRLAMTGAGIDRHLFCLYLVSKYLGVSSPFLAEVLSEPWRLSTSQIPQSQIRMFDPEQHPNHLGAGGGFGPVSAPEGG

SEQ ID NO: 847398 - protein, 135 aa, Homo sapiens [sequence omitted]

SEQ ID NO: 847399 - protein, 341 aa, Homo sapiens
MAEAHQAVAFQFTVTPDGVDFRLSREALKHVYLSGINSWKKRLIRIKNGILRGVYPGSPTSWLVVIMATVGSSFCNVDISLGLVSCIQRCLPQGCGPYQTPQTRALLSMAIFSTGVWVTGIFFFRQTLKLLLCYHGWMFEMHGKTSNLTRIWAMCIRLLSSRHPMLYSFQTSLPKLPVPRVSATIQRYLESVRPLLDDEEYYRMELLAKEFQDKTAPRLQKYLVLKSWWASNYVSDWWEEYIYLRGRSPLMVNSNYYVMDLVLIKNTDVQAARLGNIIHAMIMYRRKLDREEIKPVMALGIVPMCSYQMERMFNTTRIPGKDTGLLVLREREWKHPAQGLV

SEQ ID NO: 847400 - protein, 127 aa, Homo sapiens
MAAEATAVAGSGAVGGCLAKDGLQQSKCPDTTPKRRRASSLSRDAERRAYQWCREYLGGAWRRVQPEELRVYPVRWEVRGQPLRCADRGQGSAAGPSGCSMFSPPSCARAWGGAGPAWPGGGRGRGR

SEQ ID NO: 847401 - protein, 135 aa, Homo sapiens [sequence omitted]

SEQ ID NO: 847402 - protein, 158 aa, Homo sapiens
MAQFHGMEMPFTKEPHWLFGTMERYLKQIQDLPPTGLPEMNLLEMYSLKDEMGNLRKLLESTPSPVVFCHNDIQEGRRRHLSLLTQDGRARGLWSEQNLTPFPQGTSCCSQSQKMLTASCWWTSSTAVITIGEAGKMASHRSVPIGLLKTGQLPRAFG

SEQ ID NO: 847403 - protein, 827 aa, Homo sapiens
GLAGGAGRGQPLVAGWGARGVADWLGASRRGWRRGRPKRARAPICPRPRCRPTPRMAEAHQAVAFQFTVTPDGVDFRLSREALKHVYLSGINSWKKRLIRIKNGILRGVYPGSPTSWLVVIMATVGSSFCNVDISLGLVSCIQRCLPQGCGPYQTPQTRALLSMAIFSTGVWVTGIFFFRQTLKLLLCYHGWMFEMHGKTSNLTRIWAMCIRLLSSRHPMLYSFQTSLPKLPVPRVSATIQRYLESVRPLLDDEEYYRMELLAKEFQDKTAPRLQKYLVLKSWWASNYVSDWWEEYIYLRGRSPLMVNSNYYVMDLVLIKNTDVQAARLGNIIHAMIMYRRKLDREEIKPVMALGIVPMCSYQMERMFNTTRIPGKDTDVLQHLSDSRHVAVYHKGRFFKLWLYEGARLLKPQDLEMQFQRILDDPSPPQPGEEKLAALTAGGRVEWAQARQAFFSSGKNKAALEAIERAAFFVALDEESYSYDPEDEASLSLYGKALLHGNCYNRWFDKSFTLISFKNGQLGLNAEHAWADAPIIGHLWEFVLGTDSFHLGYTETGHCLGKPNPALAPPTRLQWDIPKQCQAVIESSYQVAKALADDVELYCFQFLPFGKGLIKKCRTSPDAFVQIALQLAHFRDRGKFCLTYEASMTRMFREGRTETVRSCTSESTAFVQAMMEGSHTKADLRDLFQKAAKKHQNMYRLAMTGAGIDRHLFCLYLVSKYLGVSSPFLAEVLSEPWRLSTSQIPQSQIRMFDPEQHPNHLGAGGGFGPVADDGYGVSYMIAGENTIFFHISSKFSSSETNAQRFGNHIRKALLDIADLFQVPKAYS

SEQ ID NO: 847404 - protein, 38 aa, Homo sapiens
MSWYELEPPGPRTCSALSQLQGKGSGGQPRALVAASVG

SEQ ID NO: 847405 - protein, 772 aa, Homo sapiens; identical to SEQ ID NO: 847388

SEQ ID NO: 847406 - protein, 772 aa, Homo sapiens; identical to SEQ ID NO: 847388

SEQ ID NO: 847407 - protein, 772 aa, Homo sapiens; identical to SEQ ID NO: 847388

SEQ ID NO: 847408 - protein, 714 aa, Homo sapiens
MASSGACTLAAPPAGWSSSWQQWVPPSATWTSPWGWCGPYQTPQTRALLSMAIFSTGVWVTGIFFFRQTLKLLLCYHGWMFEMHGKTSNLTRIWAMCIRLLSSRHPMLYSFQTSLPKLPVPRVSATIQRYLESVRPLLDDEEYYRMELLAKEFQDKTAPRLQKYLVLKSWWASNYVSDWWEEYIYLRGRSPLMVNSNYYVMDLVLIKNTDVQAARLGNIIHAMIMYRRKLDREEIKPVMALGIVPMCSYQMERMFNTTRIPGKDTDVLQHLSDSRHVAVYHKGRFFKLWLYEGARLLKPQDLEMQFQRILDDPSPPQPGEEKLAALTAGGRVEWAQARQAFFSSGKNKAALEAIERAAFFVALDEESYSYDPEDEASLSLYGKALLHGNCYNRWFDKSFTLISFKNGQLGLNAEHAWADAPIIGHLWEFVLGTDSFHLGYTETGHCLGKPNPALAPPTRLQWDIPKQCQAVIESSYQVAKALADDVELYCFQFLPFGKGLIKKCRTSPDAFVQIALQLAHFRDRGKFCLTYEASMTRMFREGRTETVRSCTSESTAFVQAMMEGSHTKADLRDLFQKAAKKHQNMYRLAMTGAGIDRHLFCLYLVSKYLGVSSPFLAEVLSEPWRLSTSQIPQSQIRMFDPEQHPNHLGAGGGFGPVADDGYGVSYMIAGENTIFFHISSKFSSSETNAQRFGNHIRKALLDIADLFQVPKAYS

SEQ ID NO: 847409 - protein, 772 aa, Homo sapiens; identical to SEQ ID NO: 847388

SEQ ID NO: 847410 - protein, 453 aa, Homo sapiens
MAEAHQAVAFQFTVTPDGVDFRLSREALKHVYLSGINSWKKRLIRIKNGILRGVYPGSPTSWLVVIMATVGSSFCNVDISLGLVSCIQRCLPQGCGPYQTPQTRALLSMAIFSTGVWVTGIFFFRQTLKLLLCYHGWMFEMHGKTSNLTRIWAMCIRLLSSRHPMLYSFQTSLPKLPVPRVSATIQRYLESVRPLLDDEEYYRMELLAKEFQDKTAPRLQKYLVLKSWWASNYVSDWWEEYIYLRGRSPLMVNSNYYVMDLVLIKNTDVQAARLGNIIHAMIMYRRKLDREEIKPVMALGIVPMCSYQMERMFNTTRIPGKDTDVLQHLSDSRHVAVYHKGRFFKLWLYEGARLLKPQDLEMQFQRILDDPSPPQPGEEKLAALTAGGRVEWAQARQAFFSSGKNKAALEAIERAAFFVALDEESYSYDPEDEASLSLYGKALLHGNCYNRCI

SEQ ID NO: 847411 - protein, 225 aa, Homo sapiens [sequence omitted]

SEQ ID NO: 847412 - protein, 135 aa, Homo sapiens [sequence omitted]

SEQ ID NO: 847413 - protein, 159 aa, Homo sapiens
MNLLEMYSLKDEMGNLRKLLESTPSPVVFCHNDIQEGRRRHLSLLTQDGRARGLWSEQNLTPFPQGTSCCSQSQKMLTASCWWTSSTAVITIGALTLGTIFVSGFMIILTRNGLSTKQGPQTTPLKNSSCILFVITWQRQRKVRPSPKRSRENWKKICW

SEQ ID NO: 847414 - protein, 136 aa, Homo sapiens
PSDCLLRTLLLKMSWPAVPFLHQLNVMPPRHDPESCLEEPYPQLTLPMSWQCQAVIESSYQVAKALADDVELYCFQFLPFGKGLIKKCRTSPDAFVQIALQLAHFRVGAPPPAAERAGWYQGPPARFTPLYIPGQG

SEQ ID NO: 847415 - protein, 254 aa, Homo sapiens
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLSSCVRTDYLD

SEQ ID NO: 847416 - protein, 254 aa, Homo sapiens; identical to SEQ ID NO: 847415

SEQ ID NO: 847417 - protein, 138 aa, Homo sapiens
MAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLSSCVRTDYLD

SEQ ID NO: 847418 - protein, 270 aa, Homo sapiens
REYQEHQQDHQHQGILSRQQGQGDQGDQLHQDVHLTHLKMGQMDPLRVIILFAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLSSCVRTDYLD

SEQ ID NO: 847419 - protein, 229 aa, Homo sapiens
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLSSCVRTDYLD

SEQ ID NO: 847420 - protein, 192 aa, Homo sapiens
RDAAGRYRGSPALTNTLITVAGDPLRVIILVAGKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLSSCVRTDYLD

SEQ ID NO: 847421 - protein, 142 aa, Homo sapiens
MRSSLPPVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLSSCVRTDYLD

SEQ ID NO: 847422 - protein, 113 aa, Homo sapiens
LSSDPMKGDETHPITSCRSAFLTAAIILLHTFWGVVFFDACERRRYWALGLVVGSHLLTSGLTFLNPWYEASLLPIYAVTVSMGLWAFITAGGSLRSIQRSLLSSCVRTDYLD

SEQ ID NO: 847423 - protein, 264 aa, Homo sapiens
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLCSALALSILSPFLSCREACP

SEQ ID NO: 847424 - protein, 252 aa, Homo sapiens
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTIPEPPGNGAWLPNLMASQVFQWGLLGPFNQQAGKGSPPGYFKRQAPWA

SEQ ID NO: 847425 - protein, 161 aa, Homo sapiens
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSG

SEQ ID NO: 847426 - protein, 136 aa, Homo sapiens
MAYVSGLSFGIISGVFSVINILADALGPGVVGIHGDSPYYFLTSAFLTAAIILLHTFWGVVFFDACERRRYWALGLVVGSHLLTSGLTIPEPPGNGAWLPNLMASQVFQWGLLGPFNQQAGKGSPPENFKRQAPWA

SEQ ID NO: 847427 - protein, 254 aa, Homo sapiens; identical to SEQ ID NO: 847415

SEQ ID NO: 847428 - protein, 318 aa, Homo sapiens
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLCRPTAGGQSGDGVFCPAHPTRGLREPRGDPWAWGALLMSSPCISPSPVLDSAGCQEKGPSLAIALEMKLMEAQG

SEQ ID NO: 847429 - protein, 254 aa, Homo sapiens; identical to SEQ ID NO: 847415

SEQ ID NO: 847430 - protein, 197 aa, Homo sapiens
MGAAVFFGCTFVAFGPAFALFLITVAGDPLRVIILVAGKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLSSCVRTDYLD

SEQ ID NO: 847431 - protein, 169 aa, Homo sapiens
HSSKALVIETKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLSSCVRTDYLD

SEQ ID NO: 847432 - protein, 167 aa, Homo sapiens
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSDIPEPLV

SEQ ID NO: 847433 - protein, 254 aa, Homo sapiens; identical to SEQ ID NO: 847415

SEQ ID NO: 847434 - protein, 161 aa, Homo sapiens
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSV

SEQ ID NO: 847435 - protein, 207 aa, Homo sapiens
MGAAVFFGCTFVAFGPAFALFLITVAGDPLRVIILVAGKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLCSALALSILSPFLSCREACP

SEQ ID NO: 847436 - protein, 757 aa, Homo sapiens [sequence omitted]

SEQ ID NO: 847437 - protein, 140 aa, Homo sapiens
MALGEEKAEAEASEDTKAQSYGRGSCRELGEPWTFPWGPNRGGGCMPPTALERLEREVLNRSAFVLRGGAMTRGDYPLLTINYGLGTFGRPLIPPWAMAHPFVKEKGPQTPRSLNKCWPPVLWNIAAESVSGKCNWPRVV

SEQ ID NO: 847438 - protein, 757 aa, Homo sapiens [sequence omitted]

SEQ ID NO: 847439 - protein, 757 aa, Homo sapiens [sequence omitted]

SEQ ID NO: 847440 - protein, 554 aa, Homo sapiens
MALGEEKAEAEASEDTKAQSYGRGSCRERELDIPGPMSGEQPPRLEAEGGLISPVWGAEGIPAPTCWIGTDPGSPSRAHQPQASDANREPVAERSEPALSGLPPATMGSGDLLLSGESQVEKTKLSSSEEFPQTLSLPRTTTICSGHDADTEDDPSLADLPQALDLSQQPHSSGLSCLSQWKSVLSPGSAAQPSSCSISASSTGSSLQGHQERAEPRGGSLAKVSSSLEPVVPQEPSSVVGLGPRPQWSPQPVFSGGDASGLGRRRLSFQAEYWACVLPDSLPPSPDRHSPLWNPNKEYEDLLDYTYPLRPGPQLPKHLDSRVPADPVLQDSGVDLDSFSVSPASTLKSPTNVSPNCPPAEATALPFSGPREPSLKQWPSRVPQKQGGMGLASWSQLASTPRAPGSRDARWERREPALRGAKDRLTIGKHLDMGSPQLRTRDRGWPSPRPEREKRTSQSARRPTCTESRWKSEEEVESDDEYLALPARLTQVSSLVSYLGSISTLVTLPTGDIKGQSPLEVSDSDGPASFPSSSSQSHFPGKEENREKNHWCNV

SEQ ID NO: 847441 - protein, 757 aa, Homo sapiens [sequence omitted]

SEQ ID NO: 847442 - protein, 188 aa, Homo sapiens
MALGEEKAEAEASEDTKAQSYGRGSCRERELDIPGPMSGEQPPRLEAEGGLISPVWGAEGIPAPTCWIGTDPGSPSRAHQPQASDANREPVAERSEPALSGLPPATMGSGDLLLSGESQVEKTKLSSSEEFPQTLSLPRTTTICSGHDADTEDDPSLADLPQALDLSQQPHSSGLSCLSQHFAVSWKS

SEQ ID NO: 847443 - protein, 160 aa, Homo sapiens [sequence omitted]

SEQ ID NO: 847444 - protein, 700 aa, Homo sapiens
MALGEEKAEAEASEDTKAQSYGRGSCRERELDIPGPMSGEQPPRLEAEGGLISPVWGAEGIPAPTCWIGTDPGSPSRAHQPQASDANREPVAERSEPALSGLPPATMGSGDLLLSGESQVEKTKLSSSEEFPQTLSLPRTTTICSGHDADTEDDPSLADLPQALDLSQQPHSSGLSCLSQWKSVLSPGSAAQPSSCSISASSTGSSLQGHQERAEPRGGSLAKVSSSLEPVVPQEPSSVVGLGPRPQWSPQPVFSGGDASGLGRRRLSFQAEYWACVLPDSLPPSPDRHSPLWNPNKEYEDLLDYTYPLRPGPQLPKHLDSRVPADPVLQDSGVDLDSFSVSPASTLKSPTNVSPNCPPAEATALPFSGPREPSLKQWPSRVPQKQGGMGLASWSQLASTPRAPGSRDARWERREPALRGAKDRLTIGKHLDMGSPQLRTRDRGWPSPRPEREKRTSQSARRPTCTESRWKSEEEVESDDEYLALPARLTQVSSLVSYLGSISTLVTLPTGDIKGQSPLEVSDSDGPASFPSSSSQSQLPPGAALQGSGDPEGQNPCFLRSFVRAHDSAGEGSLGSSQALGVSSGLLKTRPSLPARLDRWPFSDPDVEGQLPRKGGEQGKESLVQCVKTFCCQLEELICWLYNVADVTDHGTAARSNLTSLKSSLQLYRVICGPGSGLFPHKSVAKLLDYKVKSQITKIW

SEQ ID NO: 847445 - protein, 757 aa, Homo sapiens [sequence omitted]

SEQ ID NO: 847446 - protein, 502 aa, Homo sapiens
MALGEEKAEAEASEDTKAQSYGRGSCRERELDIPGPMSGEQPPRLEAEGGLISPVWGAEGIPAPTCWIGTDPGSPSRAHQPQASDANREPVAERSEPALSGLPPATMGSGDLLLSGESQVEKTKLSSSEEFPQTLSLPRTTTICSGHDADTEDDPSLADLPQALDLSQQPHSSGLSCLSQWKSVLSPGSAAQPSSCSISASSTGSSLQGHQERAEPRGGSLAKVSSSLEPVVPQEPSSVVGLGPRPQWSPQPVFSGGDASGLGRRRLSFQAEYWACVLPDSLPPSPDRHSPLWNPNKEYEDLLDYTYPLRPGPQLPKHLDSRVPADPVLQDSGVDLDSFSVSPASTLKSPTNVSPNCPPAEATALPFSGPREPSLKQWPSRVPQKQGGMGLASWSQLASTPRAPGSRDARWERREPALRGAKDRLTIGKHLDMGSPQLRTRDRGWPSPRPEREKRTSQSARRPTCTESRWKSEEEVESDDEYLALPARLTQVGPVAILRPRC

SEQ ID NO: 847447 - protein, 620 aa, Homo sapiens
MALGEEKAEAEASEDTKAQSYGRGSCRERELDIPGPMSGEQPPRLEAEGGLISPVWGAEGIPAPTCWIGTDPGSPSRAHQPQASDANREPVAERSEPALSGLPPATMGSGDLLLSGESQVEKTKLSSSEEFPQTLSLPRTTTICSGHDADTEDDPSLADLPQALDLSQQPHSSGLSCLSQWKSVLSPGSAAQPSSCSISASSTGSSLQGHQERAEPRGGSLAKVSSSLEPVVPQEPSSVVGLGPRPQWSPQPVFSGGDASGLGRRRLSFQAEYWACVLPDSLPPSPDRHSPLWNPNKEYEDLLDYTYPLRPGPQLPKHLDSRVPADPVLQDSGVDLDSFSVSPASTLKSPTNVSPNCPPAEATALPFSGPREPSLKQWPSRVPQKQGGMGLASWSQLASTPRAPGSRDARWERREPALRGAKDRLTIGKHLDMGSPQLRTRDRGWPSPRPEREKRTSQSARRPTCTESRWKSEEEVESDDEYLALPARLTQTFCCQLEELICWLYNVADVTDHGTAARSNLTSLKSSLQLYRQFKKDIDEHQSLTESVLQKGEILLQCLLENTPVLEDVLGRIAKQSGELESHADRLYDSILASLDMLAGCTLIPDKKPMAAMEHPCEGV

SEQ ID NO: 847448 - protein, 95 aa, Homo sapiens
RVLMAEIGEDLDKSDVSSLIFLMKDYMGRGKISKEKSFLDLVVELEKLNLVAPDQLDLLEKCLKNIHRIDLKTKIQKYKQSDILLSAGRADLLAV

SEQ ID NO: 847449 - protein, 673 aa, Homo sapiens
FCSPGKARWRRRSPDPMVAGGRPLSAGSDLSGESQVEKTKLSSSEEFPQTLSLPRTTTICSGHDADTEDDPSLADLPQALDLSQQPHSSGLSCLSQWKSVLSPGSAAQPSSCSISASSTGSSLQGHQERAEPRGGSLAKVSSSLEPVVPQEPSSVVGLGPRPQWSPQPVFSGGDASGLGRRRLSFQAEYWACVLPDSLPPSPDRHSPLWNPNKEYEDLLDYTYPLRPGPQLPKHLDSRVPADPVLQDSGVDLDSFSVSPASTLKSPTNVSPNCPPAEATALPFSGPREPSLKQWPSRVPQKQGGMGLASWSQLASTPRAPGSRDARWERREPALRGAKDRLTIGKHLDMGSPQLRTRDRGWPSPRPEREKRTSQSARRPTCTESRWKSEEEVESDDEYLALPARLTQVSSLVSYLGSISTLVTLPTGDIKGQSPLEVSDSDGPASFPSSSSQSQLPPGAALQGSGDPEGQNPCFLRSFVRAHDSAGEGSLGSSQALGVSSGLLKTRPSLPARLDRWPFSDPDVEGQLPRKGGEQGKESLVQCVKTFCCQLEELICWLYNVADVTDHGTAARSNLTSLKSSLQLYRQFKKDIDEHQSLTESVLQKGEILLQCLLENTPVLEDVLGRIAKQSGELESHADRLYDSILASLDMLAGCTLIPDKKPMAAMEHPCEGV

SEQ ID NO: 847450 - protein, 627 aa, Homo sapiens
MALGEEKAEAEASEDTKAQSYGRGSCRERELDIPGPMSGEQPPRLEAEGGLISPVWGAEGIPAPTCWIGTDPGSPSRAHQPQASDANREPVAERSEPALSGLPPATMGSGDLLLSGESQVEKTKLSSSEEFPQTLSLPRTTTICSGHDADTEDDPSLADLPQALDLSQQPHSSGLSCLSQWKSVLSPGSAAQPSSCSISASSTGSSLQGHQERAEPRGGSLAKVSSSLEPVVPQEPSSVVGLGPRPQWSPQPVFSGGDASGLGRRRLSFQAEYWACVLPDSLPPSPDRHSPLWNPNKEYEDLLDYTYPLRPGPQLPKHLDSRVPADPVLQDSGVDLDSFSVSPASTLKSPTNVSPNCPPAEATALPFSGPREPSLKQWPSRVPQKQGGMGLASWSQLASTPRAPGSRDARWERREPALRGAKDRLTIGKHLDMGSPQLRTRDRGWPSPRPEREKRTSQSARRPTCTESRWKSEEEVESDDEYLALPARLTQVSSLVSYLGSISTLVTLPTGDIKGQSPLEVSDSDGPASFPSSSSQSQLPPGAALQGSGDPEGQNPCFLRSFVRAHDSAGEGSLGSSQALGVSSGLLKTRPSLPARLDRWPFSDPDVEGQLPRKGGEQGHFAVSWKS

SEQ ID NO: 847451 - protein, 160 aa, Homo sapiens [sequence omitted]

SEQ ID NO: 847452 - protein, 114 aa, Homo sapiens [sequence omitted]

SEQ ID NO: 847453 - protein, 123 aa, Homo sapiens
LSPGWSCFDAEYALILRTRLRERAPYYSRALLRTARPARMWLPPRRVSRYFRCQKLALRRLLLPSSSRKVPRAMMAGLRDIAPLVNLPFRARWTSDASPGDPGAQRCDILSGLELQFCRPNTG

SEQ ID NO: 847454 - protein, 554 aa, Homo sapiens; identical to SEQ ID NO: 847440

SEQ ID NO: 847455 - protein, 188 aa, Homo sapiens; identical to SEQ ID NO: 847442

SEQ ID NO: 847456 - protein, 261 aa, Homo sapiens
MSISGVSMPTLGPLTSTLGPFRSPSSLGTEMSISPFILGPFKFKSMSLMEICGLLKCTSGILNLGPLSFPSGPSMSTSGPFRSLSTLGSETSTSPFTLGPFRCKSKSGIEILGALMFISGILNLGPFNFPSGPSILTSGVSMSKLGPFMSISGPLRSPSTLGRETSTSPFTLGPFKLKSMSGMEILGALMFISGILNFGPLSFASGPSILTSGASMSTLGPEISMSALGRVTSTSGPSPLNPGMLNLGIFTLGIFRCQSGP

SEQ ID NO: 847457 - protein, 261 aa, Homo sapiens; identical to SEQ ID NO: 847456

SEQ ID NO: 847458 - protein, 115 aa, Homo sapiens
MSTLGPLMSTSGAFRSPSILGRETSTSPFTLGPFRCKSKSGMEILGALMFISGILNLGPFSFASGPSIFTSGTSTSTLGPETSRSALGRFTSTSGPSPLKPGMLILGIFILGIFR

SEQ ID NO: 847459 - protein, 135 aa, Homo sapiens
STFPFILGPLRSRSTSGKDILGALKCISGILNFGPFNFPSGPSRLRSGALVSTFGAEMSTFALDRFTSNSGPSPLRLGMLNLGILIFGIFKFQSGPCISTSGALTSTFGPFRSPSSFGTVISYSTFTLGPFICKS

SEQ ID NO: 847460 - protein, 254 aa, Homo sapiens
VTLGADISSDGIFKDGPLSLASGPSKSRRGPLRSTSGPFKVPSTLGTDTSKSPFTLGPFKSRSTSGMEILGVLKCISGILNLGPFSFPSGPSRLTSGASMSTLGPETTTSALGKFTSTSGPSPLRLGMLNLGIFILGIFRLQSRPWPSTSGALISTLGPLMSTSGTCISPSIFGAEISTFPFILGPLRSRSTSGKDILGALKCISGILNFGPFNFPSGPSRLRSGALVSTFGAEMSTFALDRFTSNSGPSPLRL

SEQ ID NO: 847461 - protein, 261 aa, Homo sapiens; identical to SEQ ID NO: 847456

SEQ ID NO: 847462 - protein, 159 aa, Homo sapiens
MSTLGPLMSTSGAFRSPSILGRETSTSPFTLGPFRCKSKSGMEILGALMFISGILNLGPFSFASGPSIFTSGTSTSTLGPETSRSALGRFTSTSGPSPLKPGMLILGIFILGIFRCQSGPRTSTSGALISTLGPLISKSGTFMSPSTFGRDTSISPFTL

SEQ ID NO: 847463 - protein, 112 aa, Homo sapiens
MEWEHWKGAVFCDGMGTLEEALSFGCLSCTFCLTSWIMASHTWLMTESVSPICRWTPAPLSTPGPPLLLLHLFLSILKSPLKEKSSQEHPPLCLTDKEVCRCDHPTRSGQYG

SEQ ID NO: 847464 - protein, 233 aa, Homo sapiens
SLQSPPTSALGGRAGPGEGAGAGTRCAGAEAEMASAGGEDCESPAPEADRPHQRPFLIGVSGGTASGKSTVCEKIMELLGQNEVEQRQRKVVILSQDRFYKVLTAEQKAKALKGQYNFDHPDAFDNDLMHRTLKNIVEGKTVEVPTYDFVTHSRLPETTVVYPADVVLFEGILVFYSQEIRDMFHLRLFVDTDSDVRLSRRDKEVCRCDHPTRSGQYGCHQPDRAAHPGHSEW

SEQ ID NO: 847465 - protein, 234 aa, Homo sapiens
MELLGQNEVEQRQRKVVILSQDRFYKVLTAEQKAKALKGQYNFDHPDAFDNDLMHRTLKNIVEGKTVEVPTYDFVTHSRLPETTVVYPADVVLFEGILVFYSQEIRDMFHLRLFVDTDSDVRLSRRVLRDVRRGRDLEQILTQYTTFVKPAFEEFCLPTKKYADVIIPRGVDNMVAINLIVQHIQDILNGDICKWHRGGSNGRSYKRTFSEPGDHPGMLTSGKRSHLESSSRPH

SEQ ID NO: 847466 - protein, 127 aa, Homo sapiens
MFHLRLFVDTDSDVRLSRRVLRDVRRGRDLEQILTQYTTFVKPAFEEFCLPTKKYADVIIPRGVDNMVAINLIVQHIQDILNGDICKWHRGGSNGRSYKRTFSEPGDHPGMLTSGKRSHLESSSRPH

SEQ ID NO: 847467 - protein, 193 aa, Homo sapiens [sequence omitted]

SEQ ID NO: 847468 - protein, 309 aa, Homo sapiens
SLQSPPTSALGGRAGPGEGAGAGTRCAGAEAEMASAGGEDCESPAPEADRPHQRPFLIGVSGGTASGKSTVCEKIMELLGQNEVEQRQRKVVILSQDRFYKVLTAEQKAKALKGQYNFDHPDAFDNDLMHRTLKNIVEGKTVEVPTYDFVTHSRLPETTVVYPADVVLFEGILVFYSQEIRDMFHLRLFVDTDSDVRLSRRVLRDVRRGRDLEQILTQYTTFVKPAFEEFCLPTKKYADVIIPRGVDNMVAINLIVQHIQDILNGDICKWHRGGSNGRSYKRTFSEPGDHPGMLTSGKRSHLESSSRPH

SEQ ID NO: 847469 - protein, 193 aa, Homo sapiens [sequence omitted]

SEQ ID NO: 847470 - protein, 255 aa, Homo sapiens
SLQSPPTSALGGRAGPGEGAGAGTRCAGAEAEMASAGGEDCESPAPEADRPHQRPFLIGVSGGTASGKSTVCEKIMELLGQNEVEQRQRKVVILSQDRFYKVLTAEQKAKALKGQYNFDHPDAFDNDLMHRTLKNIVEGKTVEVPTYDFVTHSRLPETTVVYPADVVLFEGILVFYSQEIRDMFHLRLFVDTDSDVRLSRRVLRDVRRGRDLEQILTQYTTFVKPAFEEFCLPVPVLAASEPIFPFHKDTWDPVL

SEQ ID NO: 847471 - protein, 309 aa, Homo sapiens; identical to SEQ ID NO: 847468

SEQ ID NO: 847472 - protein, 339 aa, Homo sapiens
SLQSPPTSALGGRAGPGEGAGAGTRCAGAEAEMASAGGEDCESPAPEADRPHQRPFLIGVSGGTASGKSTVCEKIMELLGQNEVEQRQRKVVILSQDRFYKVLTAEQKAKALKGQYNFDHPDAFDNDLMHRTLKNIVEGKTVEVPTYDFVTHSRLPETTVVYPADVVLFEGILVFYSQEIRDMFHLRLFVDTDSDVRLSRRGEGGRGPPCLPGRGWRQVLRSEARLPLAAAVLRDVRRGRDLEQILTQYTTFVKPAFEEFCLPTKKYADVIIPRGVDNMVAINLIVQHIQDILNGDICKWHRGGSNGRSYKRTFSEPGDHPGMLTSGKRSHLESSSRPH

SEQ ID NO: 847473 - protein, 297 aa, Homo sapiens
SLQSPPTSALGGRAGPGEGAGAGTRCAGAEAEMASAGGEDCESPAPEADRPHQRPFLIGVSGGTASGKSTVCEKIMELLGQNEVEQRQRKVVILSQDRFYKVLTAEQKAKALKGQYNFDHPDAFDNDLMHRTLKNIVEGKTVEVPTYDFVTHSRLPETTVVYPADVVLFEGILVFYSQEIRDMFHLRLFVDTDSDVRLSRRVLRDVRRGRDLEQILTQYTTFVKPAFEEFCLPTKKYADVIIPRGVDNMVAINLIVQHIQDILNGDICKWHRGGSNGRSYKRTSGKRSHLESSSRPH

SEQ ID NO: 847474 - protein, 251 aa, Homo sapiens
SLQSPPTSALGGRAGPGEGAGAGTRCAGAEAEMASAGGEDCESPAPEADRPHQRPFLIGVSGGTASGKSTVCEKIMELLGQNEVEQRQRKVVILSQDRFYKVLTAEQKAKALKGQYNFDHPDAFDNDLMHRTLKNIVEGKTVEVPTYDFVTHSRLPETTVVYPADVVLFEGILVFYSQEIRDMFHLRLFVDTDSDVRLSRRVLRDVRRGRDLEQILTQYTTFVKPAFEEFCLPLHFLPHFLDHGLSHLADD

SEQ ID NO: 847475 - protein, 251 aa, Homo sapiens; identical to SEQ ID NO: 847474

SEQ ID NO: 847476 - protein, 72 aa, Homo sapiens
MEADCVCGLETLCLQQSPFPRAPLRLPETTVVYPADVVLFEGILVFYSQEIRDMFHLRLFVDTDSDVRLSRR

SEQ ID NO: 847477 - protein, 67 aa, Homo sapiens
SPGRNGGPSLKRLSVELDVALRGREWRSRPLYPRPQRGRWPRVALRQLRGLGKGAAEAMEEKSSQSA

SEQ ID NO: 847478 - protein, 93 aa, Homo sapiens
GAAGASPARAVLLTRRSGAQPQLSPTAGERLAGPPRLPRPGGGRAVRALILALASRGRLRPLRPALPRAPGPRRSERAAGRLGGAAEGSHSVT

SEQ ID NO: 847479 - protein, 174 aa, Homo sapiens [sequence omitted]

SEQ ID NO: 847480 - protein, 93 aa, Homo sapiens; identical to SEQ ID NO: 847478

SEQ ID NO: 847481 - protein, 48 aa, Homo sapiens
MRFLEGSLQGHISLATNPALGRWHVGSTCPSMPKHRPWSLRKSSNFLY

SEQ ID NO: 847482 - protein, 48 aa, Homo sapiens; identical to SEQ ID NO: 847481

SEQ ID NO: 847483 - protein, 128 aa, Homo sapiens
ACGWPPPHPRSAPGGPNPSPAPTLEGDGRVVDQYVEPPVLLAQEVAQGADALQVVDVQLVEARAQALRLQLLHGRLAPRHVPRGKLDNPPAQEGTSRLIPPPRHLWLQPHPGPCWHSSSSRGWGWPPQ

SEQ ID NO: 847484 - protein, 132 aa, Homo sapiens
QGARLGPWAAARGPWIPQCPHTHHAQPWSHHYSHRGPGPGPEMTVGSTILINVQVTGSLSLALAGVVVTPVEHSLMGDMPWWRTHLWLSYVRTRGEEEMDTASGASLTPRTALVIIPILVSPTLLPQLDPGL

SEQ ID NO: 847485 - protein, 126 aa, Homo sapiens [sequence omitted]

SEQ ID NO: 847486 - protein, 102 aa, Homo sapiens
GEEGKGEREREKEREKDREEREKEKEREKEEREKKEEKEEEEEKEKKKKRKRKRKKKEKKEKKKEEEEKKKEEEEEEEKKKKRKKKEEEETIAKDIMSRCAV

SEQ ID NO: 847487 - protein, 154 aa, Homo sapiens
REQQMTRRPGEDLPMRTTRDLPSAPEPRTQPPPTPARGTKPVHNCDSLGPLGHRRKRKFTLAPTRRRKQKGRKKGTAAWTTCRGQLEERLVNGRVLAPAPSAQCVPPDVPFGGAKAGVKIYPKNYTDNELEKITRRFTMELAKKGFIVFVSRQF

SEQ ID NO: 847488 - protein, 232 aa, Homo sapiens
REQQMTRRPGEDLPMRTTRDLPSAPEPRTQPPPTPARGTKPVHNCDSLGPLGHRRKRKFTLAPTRRRKQKGRKKGTAAWTTCRGQLEERLVNGRVLAPAPSAQCVPPGPRPSRFSPTPPSESAASAPAVALPSSLHLARGVLAEGQGSCAAWRGLLDAVQKPGDTFGSGRPGVTVPGANGLWLDWESTSSSVKMTDEGDLAFWGCPIALFWPEAVDHACNPSPLGGRGRRIA

SEQ ID NO: 847489 - protein, 232 aa, Homo sapiens; identical to SEQ ID NO: 847488

SEQ ID NO: 847490 - protein, 232 aa, Homo sapiens; identical to SEQ ID NO: 847488

SEQ ID NO: 847491 - protein, 364 aa, Homo sapiens
LRKWSAGSAPEEGYGSAPEVGCGGVQRAVRLARRRRGRRTRSRQRGRLGSPGAPQQEDAMDDKELIEYFKSQMKEDPDMASAVAAIRTLLEFLKRDKGETIQGLRANLTSAIETLCGVDSSVAVSSGGELFLRFISLASLEYSDYSKCKKIMIERGELFLRRISLSRNKIADLCHTFIKDGATILTHAYSRVVLRVLEAAVAAKKRFSVYVTESQPDLSGKKMAKALCHLNVPVTVVLDAAVGYIMEKADLVIVGAEGVVENGGIINKIGTNQMAVCAKAQNKPFYVVAESFKFVRLFPLNQQDVPDKFKYKADTLKVAQTGQDLKEEHPWVDYTAPSLITLLFTDLGVLTPSAVSDELIKLYL

SEQ ID NO: 847492 - protein, 364 aa, Homo sapiens; identical to SEQ ID NO: 847491

SEQ ID NO: 847493 - protein, 364 aa, Homo sapiens; identical to SEQ ID NO: 847491

SEQ ID NO: 847494 - protein, 112 aa, Homo sapiens
LVCLGLKVENGGIINKIGTNQMAVCAKAQNKPFYVVAESFKFVRLFPLNQQDVPDKFKYKADTLKVAQTGQDLKEEHPWVDYTAPSLITLLFTDLGVLTPSAVSDELIKLYL

SEQ ID NO: 847495 - protein, 364 aa, Homo sapiens; identical to SEQ ID NO: 847491

SEQ ID NO: 847496 - protein, 364 aa, Homo sapiens; identical to SEQ ID NO: 847491

SEQ ID NO: 847497 - protein, 272 aa, Homo sapiens
LRKWSAGSAPEEGYGSAPEVGCGGVQRAVRLARRRRGRRTRSRQRGRLGSPGAPQQEDAMDDKELIEYFKSQMKEDPDMASAVAAIRTLLEFLKRDKGETIQGLRANLTSAIETLCGVDSSVAVSSGGELFLRFISLASLEYSDYSKCKKIMIERGELFLRRISLSRNKIADLCHTFIKDGATILTHAYSRVVLRVLEAAVAAKKRFSVYVTESQPDLSGKKMAKALCHLNVPVTVVLDAAVGCLHPPLHSRLICLKHARCRRKAATPLCHK

SEQ ID NO: 847498 - protein, 299 aa, Homo sapiens
LRKWSAGSAPEEGYGSAPEVGCGGVQRAVRLARRRRGRRTRSRQRGRLGSPGAPQQEDAMDDKELIEYFKSQMKEDPDMASAVAAIRTLLEFLKRDKGETIQGLRANLTSAIETLCGVDSSVAVSSGGELFLRFISLASLEYSDYSKCKKIMIERGELFLRRISLSRNKIADLCHTFIKDGATILTHAYSRVVLRVLEAAVAAKKRFSVYVTESQPDLSGKKMAKALCHLNVPVTVVLDAAVGYIMEKADLVIVGAEGVVENGGIINKVRASVLPSSLLKTWRCLADLGHHSSVDYGSF

SEQ ID NO: 847499 - protein, 285 aa, Homo sapiens
LRKWSAGSAPEEGYGSAPEVGCGGVQRAVRLARRRRGRRTRSRQRGRLGSPGAPQQEDAMDDKELIEYFKSQMKEDPDMASAVAAIRTLLEFLKRDKGETIQGLRANLTSAIETLCGVDSSVAVSSGGELFLRFISLASLEYSDYSKCKKIMIERGELFLRRISLSRNKIADLCHTFIKDGATILTHAYSRVVLRVLEAAVAAKKRFSVYVTESQPDLSGKKMAKALCHLNVPVTVVLDAAVGGECPSSPAIITSPTPCWLTASFQIESLSPVHKATPGSVLLLN

SEQ ID NO: 847500 - protein, 85 aa, Homo sapiens
MSLWVHLWHWNQQSSSKSEIPKSTVLIVLLPVVNKPFSNSSSVILPFLSFFKSLVSLRSSSMSSSSISEPEEFEKSSNRGPLERR

SEQ ID NO: 847501 - protein, 364 aa, Homo sapiens; identical to SEQ ID NO: 847491

SEQ ID NO: 847502 - protein, 142 aa, Homo sapiens [sequence omitted]

SEQ ID NO: 847503 - protein, 110 aa, Homo sapiens
MKSFFSPYIMEKADLVIVGAEGVVETQNKPFYVVAESFKFVRLFPLNQQDVPDKFKYKADTLKVAQTGQDLKEEHPWVDYTAPSLITLLFTDLGVLTPSAVSDELIKLYL

SEQ ID NO: 847504 - protein, 71 aa, Homo sapiens
GQSTKYSVPTNVYFSPQYKADTLKVAQTGQDLKEEHPWVDYTAPSLITLLFTDLGVLTPSAVSDELIKLYL

SEQ ID NO: 847505 - protein, 299 aa, Homo sapiens; identical to SEQ ID NO: 847498

SEQ ID NO: 847506 - protein, 84 aa, Homo sapiens
PHGLFLLSRFDDDKGFWCQGLEGGKTRCLGRSKGRRYPDMDTESRLFLTDFFRNHNLELSKLLSRLGQPVPSWLREELQHSSLG

SEQ ID NO: 847507 - protein, 982 aa, Homo sapiens
MLQLWKVVRPARQLELHRLILLLIAFSLGSMGFLAYYVSTSPKAKEPLPLPLGDCSSGGAAGPGPARPPVPPRPPRPPETARTEPVVLVFVESAYSQLGQEIVAILESSRFRYSTELAPGRGDMPTLTDNTHGRYVLVIYENLLKYVNLDAWSRELLDRYCVEYGVGIIGFFRAHEHSLLSAQLKGFPLFLHSNLGLRDYQVNPSAPLLHLTRPSRLEPGPLPGDDWTIFQSNHSTYEPVLLASLRPAEPAVPGPVLRRARLPTVVQDLGLHDGIQRVLFGHGLSFWLHKLIFVDAVAYLTGKRLCLDLDRYILVDIDDIFVGKEGTRMKVADVEALLTTQNKLRTLVPNFTFNLGFSGKFYHTGELIPLLLWHIIVCPVPSLSTSLGRQVEEKGQGLGSDCCEELVVGMNLGSHGWLDGKLAVGQIESLRQGSGMEGGQCCYKIKEGTGADWLWSVVSVVVIGTEEEDAGDDMLLKHRKEFWWFPHMWSHMQPHLFHNRSVLADQMRLNKQFALEHGIPTDLGYAVAPHHSGVYPIHTQLYEAWKSVWGIQVTSTEEYPHLRPARYRRGFIHNGIMVLPRQTCGLFTHTIFYNEYPGGSRELDRSIRGGELFLTVLLNPISIFMTHLSNYGNDRLGLYTFESLVRFLQCWTRLRLQTLPPVPLAQKYFELFPQERSPLWQNPCDDKRHKDIWSKEKTCDRLPKFLIVGPQKTGTTAIHFFLSLHPAVTSSFPSPSTFEEIQFFNSPNYHKGIDWYMDFFPVPSNASTDFLFEKSATYFDSEVVPRRGAALLPRAKIITVLTNPADRAYSWYQHQRAHGDPVALNYTFYQVISASSQTPLALRSLQNRCLVPGYYSTHLQRWLTYYPSGQLLIVDGQELRTNPAASMESIQKFLGITPFLNYTRTLRFDDDKGFWCQGLEGGKTRCLGRSKGRRYPDMDTESRLFLTDFFRNHNLELSKLLSRLGQPVPSWLREELQHSSLG

SEQ ID NO: 847508 - protein, 886 aa, Homo sapiens
MLQLWKVVRPARQLELHRLILLLIAFSLGSMGFLAYYVSTSPKAKEPLPLPLGDCSSGGAAGPGPARPPVPPRPPRPPETARTEPVVLVFVESAYSQLGQEIVAILESSRFRYSTELAPGRGDMPTLTDNTHGRYVLVIYENLLKYVNLDAWSRELLDRYCVEYGVGIIGFFRAHEHSLLSAQLKGFPLFLHSNLGLRDYQVNPSAPLLHLTRPSRLEPGPLPGDDWTIFQSNHSTYEPVLLASLRPAEPAVPGPVLRRARLPTVVQDLGLHDGIQRVLFGHGLSFWLHKLIFVDAVAYLTGKRLCLDLDRYILVDIDDIFVGKEGTRMKVADVEALLTTQNKLRTLVPNFTFNLGFSGKFYHTGTEEEDAGDDMLLKHRKEFWWFPHMWSHMQPHLFHNRSVLADQMRLNKQFALEHGIPTDLGYAVAPHHSGVYPIHTQLYEAWKSVWGIQVTSTEEYPHLRPARYRRGFIHNGIMVLPRQTCGLFTHTIFYNEYPGGSRELDRSIRGGELFLTVLLNPISIFMTHLSNYGNDRLGLYTFESLVRFLQCWTRLRLQTLPPVPLAQKYFELFPQERSPLWQNPCDDKRHKDIWSKEKTCDRLPKFLIVGPQKTGTTAIHFFLSLHPAVTSSFPSPSTFEEIQFFNSPNYHKGIDWYMDFFPVPSNASTDFLFEKSATYFDSEVVPRRGAALLPRAKIITVLTNPADRAYSWYQHQRAHGDPVALNYTFYQVISASSQTPLALRSLQNRCLVPGYYSTHLQRWLTYYPSGQLLIVDGQELRTNPAASMESIQKFLGITPFLNYTRTLRFDDDKGFWCQGLEGGKTRCLGRSKGRRYPDMDTEVSKARGRGIPLHFQDLILCPTSYHFCLHFLLSVPSFPYGFFPEP

SEQ ID NO: 847509 - protein, 815 aa, Homo sapiens
MLQLWKVVRPARQLELHRLILLLIAFSLGSMGFLAYYVSTSPKAKEPLPLPLGDCSSGGAAGPGPARPPVPPRPPRPPETARTEPVVLVFVESAYSQLGQEIVAILESSRFRYSTELAPGRGDMPTLTDNTHGRYVLVIYENLLKYVNLDAWSRELLDRYCVEYGVGIIGFFRAHEHSLLSAQLKGFPLFLHSNLGLRDYQVNPSAPLLHLTRPSRLEPGPLPGDDWTIFQSNHSTYEPVLLASLRPAEPAVPGPVLRRARLPTVVQDLGLHDGIQRVLFGHGLSFWLHKLIFVDAVAYLTGKRLCLDLDRYILVDIDDIFVGKEGTRMKVADVEALLTTQNKLRTLVPNFTFNLGFSGKFYHTGTEEEDAGDDMLLKHRKEFWWFPHMWSHMQPHLFHNRSVLADQMRLNKQFALEHGIPTDLGYAVAPHHSGVYPIHTQLYEAWKSVWGIQVTSTEEYPHLRPARYRRGFIHNGIMVLPRQTCGLFTHTIFYNEYPGGSRELDRSIRGGELFLTVLLNPISIFMTHLSNYGNDRLGLYTFESLVRFLQCWTRLRLQTLPPVPLAQKYFELFPQERSPLWQNPCDDKRHKDIWSKEKTCDRLPKFLIVGPQKTGTTAIHFFLSLHPAVTSSFPSPSTFEEIQFFNSPNYHKGIDWYMDFFPVPSNASTDFLFEKSATYFDSEVVPRRGAALLPRAKIITVLTNPADRAYSWYQHQRAHGDPVALNYTFYQVISASSQTPLALRSLQNRCLVPGYYSTHLQRWLTYYPSGQLLIVDGQELRTNPAASMESIQKFLGLMMIRDFGARDLKVVRLAV

SEQ ID NO: 847510 - protein, 1069 aa, Homo sapiens
MLQLWKVVRPARQLELHRLILLLIAFSLGSMGFLAYYVSTSPKAKEPLPLPLGDCSSGGAAGPGPARPPVPPRPPRPPETARTEPVVLVFVESAYSQLGQEIVAILESSRFRYSTELAPGRGDMPTLTDNTHGRYVLVIYENLLKYVNLDAWSRELLDRYCVEYGVGIIGFFRAHEHSLLSAQLKGFPLFLHSNLGLRDYQVNPSAPLLHLTRPSRLEPGPLPGDDWTIFQSNHSTYEPVLLASLRPAEPAVPGPVLRRARLPTVVQDLGLHDGIQRVLFGHGLSFWLHKLIFVDAVAYLTGKRLCLDLDRYILVDIDDIFVGKEGTRMKVADVEALLTTQNKLRTLVPNFTFNLGFSGKFYHTGELIPLLLWHIIVCPVPSLSTSLGRQVEEKGQGLGSDCCEELVVGMNLGSHGWLDGKLAVGQIESLRQGSGMEGGQCCYKIKEGTGADWLWSVVSVVVIGTEEEDAGDDMLLKHRKEFWWFPHMWSHMQPHLFHNRSVLADQMRLNKQFALEHGIPTDLGYAVAPHHSGVYPIHTQLYEAWKSVWGIQVTSTEEYPHLRPARYRRGFIHNGIMVRDSQYRLESNSNISDSFQHALTYVLYQLPVQVWGYIIGGRKVKKFNTLSKSFIAITSDSVLYEIPVSSIYFSFYLSNLICFFFSLQVLPRQTCGLFTHTIFYNEYPGGSRELDRSIRGGELFLTVLLNPISIFMTHLSNYGNDRLGLYTFESLVRFLQCWTRLRLQTLPPVPLAQKYFELFPQERSPLWQNPCDDKRHKDIWSKEKTCDRLPKFLIVGPQKTGTTAIHFFLSLHPAVTSSFPSPSTFEEIQFFNSPNYHKGIDWYMDFFPVPSNASTDFLFEKSATYFDSEVVPRRGAALLPRAKIITVLTNPADRAYSWYQHQRAHGDPVALNYTFYQVISASSQTPLALRSLQNRCLVPGYYSTHLQRWLTYYPSGQLLIVDGQELRTNPAASMESIQKFLGITPFLNYTRTLRFDDDKGFWCQGLEGGKTRCLGRSKGRRYPDMDTESRLFLTDFFRNHNLELSKLLSRLGQPVPSWLREELQHSSLG

SEQ ID NO: 847511 - protein, 57 aa, Homo sapiens
MTHLSNYGNDRLGLYTFESLVRFLQCWTRLRLQTLPPVPLAQKYFELFPQERSPLWQ

SEQ ID NO: 847512 - protein, 883 aa, Homo sapiens
MLQLWKVVRPARQLELHRLILLLIAFSLGSMGFLAYYVSTSPKAKEPLPLPLGDCSSGGAAGPGPARPPVPPRPPRPPETARTEPVVLVFVESAYSQLGQEIVAILESSRFRYSTELAPGRGDMPTLTDNTHGRYVLVIYENLLKYVNLDAWSRELLDRYCVEYGVGIIGFFRAHEHSLLSAQLKGFPLFLHSNLGLRDYQVNPSAPLLHLTRPSRLEPGPLPGDDWTIFQSNHSTYEPVLLASLRPAEPAVPGPVLRRARLPTVVQDLGLHDGIQRVLFGHGLSFWLHKLIFVDAVAYLTGKRLCLDLDRYILVDIDDIFVGKEGTRMKVADVEALLTTQNKLRTLVPNFTFNLGFSGKFYHTGTEEEDAGDDMLLKHRKEFWWFPHMWSHMQPHLFHNRSVLADQMRLNKQFALEHGIPTDLGYAVAPHHSGVYPIHTQLYEAWKSVWGIQVTSTEEYPHLRPARYRRGFIHNGIMVLPRQTCGLFTHTIFYNEYPGGSRELDRSIRGGELFLTVLLNPISIFMTHLSNYGNDRLGLYTFESLVRFLQCWTRLRLQTLPPVPLAQKYFELFPQERSPLWQNPCDDKRHKDIWSKEKTCDRLPKFLIVGPQKTGTTAIHFFLSLHPAVTSSFPSPSTFEEIQFFNSPNYHKGIDWYMDFFPVPSNASTDFLFEKSATYFDSEVVPRRGAALLPRAKIITVLTNPADRAYSWYQHQRAHGDPVALNYTFYQVISASSQTPLALRSLQNRCLVPGYYSTHLQRWLTYYPSGQLLIVDGQELRTNPAASMESIQKFLGITPFLNYTRTLRFDDDKGFWCQGLEGGKTRCLGRSKGRRYPDMDTESRLFLTDFFRNHNLELSKLLSRLGQPVPSWLREELQHSSLG

SEQ ID NO: 847513 - protein, 815 aa, Homo sapiens; identical to SEQ ID NO: 847509

SEQ ID NO: 847514 - protein, 1043 aa, Homo sapiens
MLQLWKVVRPARQLELHRLILLLIAFSLGSMGFLAYYVSTSPKAKEPLPLPLGDCSSGGAAGPGPARPPVPPRPPRPPETARTEPVVLVFVESAYSQLGQEIVAILESSRFRYSTELAPGRGDMPTLTDNTHGRYVLVIYENLLKYVNLDAWSRELLDRYCVEYGVGIIGFFRAHEHSLLSAQLKGFPLFLHSNLGLRDYQVNPSAPLLHLTRPSRLEPGPLPGDDWTIFQSNHSTYEPVLLASLRPAEPAVPGPVLRRARLPTVVQDLGLHDGIQRVLFGHGLSFWLHKLIFVDAVAYLTGKRLCLDLDRYILVDIDDIFVGKEGTRMKVADVEALLTTQNKLRTLVPNFTFNLGFSGKFYHTGELIPLLLWHIIVCPVPSLSTSLGRQVEEKGQGLGSDCCEELVVGMNLGSHGWLDGKLAVGQIESLRQGSGMEGGQCCYKIKEGTGADWLWSVVSVVVIGTEEEDAGDDMLLKHRKEFWWFPHMWSHMQPHLFHNRSVLADQMRLNKQFALVRPLDLFPIISPSHASFSTFPYMGYPFPILCVFLYLEASPPSLPSTPQTSPGPGESLCHSQEHGIPTDLGYAVAPHHSGVYPIHTQLYEAWKSVWGIQVTSTEEYPHLRPARYRRGFIHNGIMVLPRQTCGLFTHTIFYNEYPGGSRELDRSIRGGELFLTVLLNPISIFMTHLSNYGNDRLGLYTFESLVRFLQCWTRLRLQTLPPVPLAQKYFELFPQERSPLWQNPCDDKRHKDIWSKEKTCDRLPKFLIVGPQKTGTTAIHFFLSLHPAVTSSFPSPSTFEEIQFFNSPNYHKGIDWYMDFFPVPSNASTDFLFEKSATYFDSEVVPRRGAALLPRAKIITVLTNPADRAYSWYQHQRAHGDPVALNYTFYQVISASSQTPLALRSLQNRCLVPGYYSTHLQRWLTYYPSGQLLIVDGQELRTNPAASMESIQKFLGITPFLNYTRTLRFDDDKGFWCQGLEGGKTRCLGRSKGRRYPDMDTESRLFLTDFFRNHNLELSKLLSRLGQPVPSWLREELQHSSLG

SEQ ID NO: 847515 - protein, 815 aa, Homo sapiens; identical to SEQ ID NO: 847509

SEQ ID NO: 847516 - protein, 102 aa, Homo sapiens
MNEAEIVDVALGILIESRKQEKACEQPALAGADNPEHSPPCSVSPHTSSGSSSEEEDSGKQALAPGLSPSQRPGGSSSACSRSPEEEEEEDVLKYVREIFFS

SEQ ID NO: 847517 - protein, 102 aa, Homo sapiens; identical to SEQ ID NO: 847516

SEQ ID NO: 847518 - protein, 102 aa, Homo sapiens; identical to SEQ ID NO: 847516

SEQ ID NO: 847519 - protein, 102 aa, Homo sapiens; identical to SEQ ID NO: 847516

SEQ ID NO: 847520 - protein, 102 aa, Homo sapiens; identical to SEQ ID NO: 847516

SEQ ID NO: 847521 - protein, 102 aa, Homo sapiens; identical to SEQ ID NO: 847516

SEQ ID NO: 847522 - protein, 102 aa, Homo sapiens; identical to SEQ ID NO: 847516

SEQ ID NO: 847523 - protein, 157 aa, Homo sapiens
METLQSETKTRVLPSWLTAQVATKNVAPMKAPKRMRMAAVPVAAARLPATRTVYCMNEAEIVDVALGILIESRKQEKACEQPALAGADNPEHSPPCSVSPHTSSGSSSEEEDSGKQALAPGLSPSQRPGGSSSACSRSPEEEEEEDVLKYVREIFFS

SEQ ID NO: 847524 - protein, 102 aa, Homo sapiens; identical to SEQ ID NO: 847516

SEQ ID NO: 847525 - protein, 218 aa, Homo sapiens
MVSAQASAGEVSAHASRASSRFFLPVAAPPLCIKRVCRHSLCSRLGRGVLSLRRRGGADRRVGLVVTPRLWRAVGNTVVSVVPPRVAAGLRVSPVRGGVGCCAPVFCSSAPPLAGVVWGCVRFSAVWCYWCARVFFSTSLARLVFLDRPRRLCRLAVIYNSGCSAILGRPPLFTQELLGCVAITFGAPRGEIRRRRPPFFFFCFFFFFFFFFFVFVFY

SEQ ID NO: 847526 - protein, 102 aa, Homo sapiens; identical to SEQ ID NO: 847516

SEQ ID NO: 847527 - protein, 102 aa, Homo sapiens; identical to SEQ ID NO: 847516

SEQ ID NO: 847528 - protein, 717 aa, Homo sapiens
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRVRRRRGTGGSESSRASGLVGRKATEDFLGSSSGYSSEDDYVGYSDVDQQSSSSRLRSAVSRAGSLLWMVATSPGRLFRLLYWWAGTTWYRLTTAASLLDVFVLTRRFSSLKTFLWFLLPLLLLTCLTYGAWYFYPYGLQTFHPALVSWWAAKDSRRPDEGWEARDSSPHFQAEQRVMSRVHSLERRLEALAAEFSSNWQKEAMRLERLELRQGAPGQGGGGGLSHEDTLALLEGLVSRREAALKEDFRRETAARIQEELSALRAEHQQDSEDLFKKIVRASQESEARIQQLKSEWQSMTQESFQESSVKELRRLEDQLAGLQQELAALALKQSSVAEEVGLLPQQIQAVRDDVESQFPAWISQFLARGGGGRVGLLQREEMQAQLRELESKILTHVAEMQGKSAREAAASLSLTLQKEGVIGVTEEQVHHIVKQALQRYSEDRIGLADYALESGGASVISTRCSETYETKTALLSLFGIPLWYHSQSPRVILQPDVHPGNCWAFQGPQGFAVVRLSARIRPTAVTLEHVPKALSPNSTISSAPKDFAIFGFDEDLQQEGTLLGKFTYDQDGEPIQTFHFQAPTMATYQVVELRILTNWGHPEYTCIYRFRVHGEPAH

SEQ ID NO: 847529 - protein, 671 aa, Homo sapiens
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGYSDVDQQSSSSRLRSAVSRAGSLLWMVATSPGRLFRLLYWWAGTTWYRLTTAASLLDVFVLTRRFSSLKTFLWFLLPLLLLTCLTYGAWYFYPYGLQTFHPALVSWWAAKDSRRPDEGWEARDSSPHFQAEQRVMSRVHSLERRLEALAAEFSSNWQKEAMRLERLELRQGAPGQGGGGGLSHEDTLALLEGLVSRREAALKEDFRRETAARIQEELSALRAEHQQDSEDLFKKIVRASQESEARIQQLKSEWQSMTQESFQESSVKELRRLEDQLAGLQQELAALALKQSSVAEEVGLLPQQIQAVRDDVESQFPAWISQFLARGGGGRVGLLQREEMQAQLRELESKILTHVAEMQGKSAREAAASLSLTLQKEGVIGVTEEQVHHIVKQALQRYSEDRIGLADYALESGGASVISTRCSETYETKTALLSLFGIPLWYHSQSPRVILQPDVHPGNCWAFQGPQGFAVVRLSARIRPTAVTLEHVPKALSPNSTISSAPKDFAIFGFDEDLQQEGTLLGKFTYDQDGEPIQTFHFQAPTMATYQVVELRILTNWGHPEYTCIYRFRVHGEPAH

SEQ ID NO: 847530 - protein, 441 aa, Homo sapiens [sequence omitted]

SEQ ID NO: 847531 - protein, 680 aa, Homo sapiens
MALCWNVSGIFSLSFCVGCVGVVFGKHYHPRVPHSVALSLPFQAEQRVMSRVHSLERRLEALAAEFSSNWQKEAMRLERLELRQGAPGQGGGGGLSHEDTLALLEGLVSRREAALKEDFRRETAARIQEELSALRAEHQQDSEDLFKKIVRASQESEARIQQLKSEWQRYWAPPAGLGLLLPSPTHSPGRTGEQSRRAESSDHLAKQMVGGGVETQLRTPAQGLSLRCHGGEQGGPEGGGQAVGEDRDSFIDTASFLTASHNCLLMPQMSMLVEDVEAEAEYILDSGLRKGAGSELAPWDRQGFCSQNPQERPCPFSGSQGVLGTRSPDGSPLGGPLSSLVWPYLPPKRSEAYSSLSGTSMTQESFQESSVKELRRLEDQLAGLQQELAALALKQSSVAEEVGLLPQQIQAVRDDVESQFPAWISQFLARGGGGRVGLLQREEMQAQLRELESKILTHVAEMQGKSAREAAASLSLTLQKEGVIGVTEEQVHHIVKQALQRYSEDRIGLADYALESGGASVISTRCSETYETKTALLSLFGIPLWYHSQSPRVILQPDVHPGNCWAFQGPQGFAVVRLSARIRPTAVTLEHVPKALSPNSTISSAPKDFAIFGFDEDLQQEGTLLGKFTYDQDGEPIQTFHFQAPTMATYQVVELRILTNWGHPEYTCIYRFRVHGEPAH

SEQ ID NO: 847532 - protein, 489 aa, Homo sapiens
MALCWNVSGIFSLSFCVGCVGVVFGKHYHPRVPHSVALSLPFQAEQRVMSRVHSLERRLEALAAEFSSNWQKEAMRLERLELRQGAPGQGGGGGLSHEDTLALLEGLVSRREAALKEDFRRETAARIQEELSALRAEHQQDSEDLFKKIVRASQESEARIQQLKSEWQSMTQESFQESSVKELRRLEDQLAGLQQELAALALKQSSVAEEVGLLPQQIQAVRDDVESQFPAWISQFLARGGGGRVGLLQREEMQAQLRELESKILTHVAEMQGKSAREAAASLSLTLQKEGVIGVTEEQVHHIVKQALQRYSEDRIGLADYALESGGASVISTRCSETYETKTALLSLFGIPLWYHSQSPRVILQPDVHPGNCWAFQGPQGFAVVRLSARIRPTAVTLEHVPKALSPNSTISSAPKDFAIFGFDEDLQQEGTLLGKFTYDQDGEPIQTFHFQAPTMATYQVVELRILTNWGHPEYTCIYRFRVHGEPAH

SEQ ID NO: 847533 - protein, 246 aa, Homo sapiens
PHSRSAGLRRPHCPPARACPASPLFACPLRPGPGRCVALSGAPPAGSPRGKGARPGGGLASDAPGRARSRRGSRFSSGEESTSHLIMSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRVRRRRGTGGSESSRASGLVGRKATEDFLGSSSGYSSEDDYVGYSDVDQQSSSSRLRSAAH

SEQ ID NO: 847534 - protein, 464 aa, Homo sapiens
MALCWNVSGIFSLSFCVGCVGVVFGKHYHPRVPHSVALSLPFQAEQRVMSRVHSLERRLEALAAEFSSNWQKEAMRLERLELRQGAPGQGGGGGLSHEDTLALLEGLVSRREAALKEDFRRETAARIQEELSALRAEHQQDSEDLFKKIVRASQESEARIQQLKSEWQSMTQESFQESSVKELRRLEDQLAGLQQELAALALKQSSVAEEVGLLPQQIQAVRDDVESQFPAWISQFLARGGGGRVGLLQREEMQAQLRELESKILTHVAEMQGKSAREAAASLSLTLQKEGVIGVTEEQVHHIVKQALQRYSEDRIGLADYALESGGASVISTRCSETYETKTALLSLFGIPLWYHSQSPRVILQPDVHPGNCWAFQGPQGFAVVRLSARIRPTAVTLEHVPKALSPNSTISSAPKDFAIFGFDEDLQQEGTLLGKFTYDQDGEPIQTFHFQVCLHRPPHLTRP

SEQ ID NO: 847535 - protein, 355 aa, Homo sapiens
MALCWNVSGIFSLSFCVGCVGVVFGKHYHPRVPHSVALSLPFQAEQRVMSRVHSLERRLEALAAEFSSNWQKEAMRLERLELRQGAPGQGGGGGLSHEDTLALLEGLVSRREAALKEDFRRETAARIQEELSALRAEHQQDSEDLFKKIVRASQESEARIQQLKSEWQSMTQESFQESSVKELRRLEDQLAGLQQELAALALKQSSVAEEVGLLPQQIQAVRDDVESQFPAWISQFLARGGGGRVGLLQREEMQAQLRELESKILTHVAEMQGKSAREAAASLSLTLQKEGVIGVTEEVRPTCPSPHTHPQLSSLGALDSPTLPAPWQVPGWKCQAGGFACCGAGMGGWQCAHIC

SEQ ID NO: 847536 - protein, 52 aa, Homo sapiens
LLLSLQAPQGDTPLGSYRWNLSSRPGSVSSLPEVEGAAWGSFRERRCKLSCE

SEQ ID NO: 847537 - protein, 489 aa, Homo sapiens; identical to SEQ ID NO: 847532

SEQ ID NO: 847538 - protein, 769 aa, Homo sapiens
MVSPPSAGQRLRGVPVWAAGAFRFSSGEESTSHLIMSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGECGALRPGALLPRPPARYSSQCPLQSPGFPPQSTSLPRPHFSEALGGPEEPLVLPCTGEDLRVRRRRGTGGSESSRASGLVGRKATEDFLGSSSGYSSEDDYVWAGTTWYRLTTAASLLDVFVLTRRFSSLKTFLWFLLPLLLLTCLTYGAWYFYPYGLQTFHPALVSWWAAKDSRRPDEGWEARDSSPHFQAEQRVMSRVHSLERRLEALAAEFSSNWQKEAMRLERLELRQGAPGQGGGGGLSHEDTLALLEGLVSRREAALKEDFRRETAARIQEELSALRAEHQQDSEDLFKKIVRASQESEARIQQLKSEWQSMTQESFQESSVKELRRLEDQLAGLQQELAALALKQSSVAEEVGLLPQQIQAVRDDVESQFPAWISQFLARGGGGRVGLLQREEMQAQLRELESKILTHVAEMQGKSAREAAASLSLTLQKEGVIGVTEEQVHHIVKQALQRYSEDRIGLADYALESGGASVISTRCSETYETKTALLSLFGIPLWYHSQSPRVILQPDVHPGNCWAFQGPQGFAVVRLSARIRPTAVTLEHVPKALSPNSTISSAPKDFAIFGFDEDLQQEGTLLGKFTYDQDGEPIQTFHFQAPTMATYQVVELRILTNWGHPEYTCIYRFRVHGEPAH

SEQ ID NO: 847539 - protein, 762 aa, Homo sapiens
PHSRSAGLRRPHCPPARACPASPLFACPLRPGPGRCVALSGAPPAGSPRGKGARPGGGLASDAPGRARSRRGSRFSSGEESTSHLIMSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRVRRRRGTGGSESSRASGLVGRKATEDFLGSSSGYSSEDDYVWAGTTWYRLTTAASLLDVFVLTRRFSSLKTFLWFLLPLLLLTCLTYGAWYFYPYGLQTFHPALVSWWAAKDSRRPDEGWEARDSSPHFQAEQRVMSRVHSLERRLEALAAEFSSNWQKEAMRLERLELRQGAPGQGGGGGLSHEDTLALLEGLVSRREAALKEDFRRETAARIQEELSALRAEHQQDSEDLFKKIVRASQESEARIQQLKSEWQSMTQESFQESSVKELRRLEDQLAGLQQELAALALKQSSVAEEVGLLPQQIQAVRDDVESQFPAWISQFLARGGGGRVGLLQREEMQAQLRELESKILTHVAEMQGKSAREAAASLSLTLQKEGVIGVTEEQVHHIVKQALQRYSEDRIGLADYALESGGASVISTRCSETYETKTALLSLFGIPLWYHSQSPRVILQPDVHPGNCWAFQGPQGFAVVRLSARIRPTAVTLEHVPKALSPNSTISSAPKDFAIFGFDEDLQQEGTLLGKFTYDQDGEPIQTFHFQAPTMATYQVVELRILTNWGHPEYTCIYRFRVHGEPAH

SEQ ID NO: 847540 - protein, 320 aa, Homo sapiens [sequence omitted]

SEQ ID NO: 847541 - protein, 489 aa, Homo sapiens; identical to SEQ ID NO: 847532

SEQ ID NO: 847542 - protein, 489 aa, Homo sapiens; identical to SEQ ID NO: 847532

SEQ ID NO: 847543 - protein, 372 aa, Homo sapiens
PHSRSAGLRRPHCPPARACPASPLFACPLRPGPGRCVALSGAPPAGSPRGKGARPGGGLASDAPGRARSRRGSRFSSGEESTSHLIMSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRVRRRRGTGGSESSRASGLVGRKATEDFLGSSSGYSSEDDYVGYSDVDQQSSSSRLRSAVSRAGSLLWMVATSPGRLFRLLYWWAGTTWYRLTTAASLLDVFVLTRRFSSLKTFLWFLLPLLLLTCLTYGAWYFYPYGLQTFHPALVSWWAAKDSRRPDEGWEARDSSPHFQAGFQERTKATRPLRP

SEQ ID NO: 847544 - protein, 191 aa, Homo sapiens
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQKGLKNVFDEAILAALEPPEPKKSRRCVLL

SEQ ID NO: 847545 - protein, 191 aa, Homo sapiens
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQRGLKNVFDEAILAALEPPETQPKRKCCIF

SEQ ID NO: 847546 - protein, 167 aa, Homo sapiens
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQKVRMA

SEQ ID NO: 847547 - protein, 191 aa, Homo sapiens; identical to SEQ ID NO: 847544

SEQ ID NO: 847548 - protein, 191 aa, Homo sapiens; identical to SEQ ID NO: 847544

SEQ ID NO: 847549 - protein, 191 aa, Homo sapiens; identical to SEQ ID NO: 847544

SEQ ID NO: 847550 - protein, 191 aa, Homo sapiens; identical to SEQ ID NO: 847544

SEQ ID NO: 847551 - protein, 191 aa, Homo sapiens; identical to SEQ ID NO: 847544

SEQ ID NO: 847552 - protein, 191 aa, Homo sapiens; identical to SEQ ID NO: 847544

SEQ ID NO: 847553 - protein, 191 aa, Homo sapiens; identical to SEQ ID NO: 847544

SEQ ID NO: 847554 - protein, 96 aa, Homo sapiens
STSCSSPLNSMPYRILTAGISCPLYTLTDCLVSVQCMIALKARPETAEKLARDLKAVKYVECSALTQKGLKNVFDEAILAALEPPEPKKSRRCVLL

SEQ ID NO: 847555 - protein, 191 aa, Homo sapiens; identical to SEQ ID NO: 847544

SEQ ID NO: 847556 - protein, 191 aa, Homo sapiens; identical to SEQ ID NO: 847544

SEQ ID NO: 847557 - protein, 191 aa, Homo sapiens; identical to SEQ ID NO: 847544

SEQ ID NO: 847558 - protein, 191 aa, Homo sapiens; identical to SEQ ID NO: 847544

SEQ ID NO: 847559 - protein, 191 aa, Homo sapiens; identical to SEQ ID NO: 847544

SEQ ID NO: 847560 - protein, 191 aa, Homo sapiens; identical to SEQ ID NO: 847544

SEQ ID NO: 847561 - protein, 191 aa, Homo sapiens; identical to SEQ ID NO: 847544

SEQ ID NO: 847562 - protein, 158 aa, Homo sapiens
MRVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQKGLKNVFDEAILAALEPPEPKKSRRCVLL

SEQ ID NO: 847563 - protein, 191 aa, Homo sapiens; identical to SEQ ID NO: 847544

SEQ ID NO: 847564 - protein, 191 aa, Homo sapiens; identical to SEQ ID NO: 847544

SEQ ID NO: 847565 - protein, 192 aa, Homo sapiens
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLTCRYRHQPLCTVSSRTRYFSPPTHNSQGPWATPNHPQHSPSPYVLPEGSAVCLSRQASSSRPR

SEQ ID NO: 847566 - protein, 339 aa, Homo sapiens
MNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVDADSSYFKIFKTKHD

SEQ ID NO: 847567 - protein, 339 aa, Homo sapiens; identical to SEQ ID NO: 847566

SEQ ID NO: 847568 - protein, 339 aa, Homo sapiens; identical to SEQ ID NO: 847566

SEQ ID NO: 847569 - protein, 339 aa, Homo sapiens; identical to SEQ ID NO: 847566

SEQ ID NO: 847570 - protein, 225 aa, Homo sapiens
MNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYL

SEQ ID NO: 847571 - protein, 259 aa, Homo sapiens
MNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVDADSSYFKIFKTKHD

SEQ ID NO: 847572 - protein, 221 aa, Homo sapiens
MNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRVRLLKLNSDR

SEQ ID NO: 847573 - protein, 137 aa, Homo sapiens
MNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRVSSILY

SEQ ID NO: 847574 - protein, 382 aa, Homo sapiens
TKAVLQEFGRIDILVNNGGMSQRSLCMDTSLDVYSNPRLLRVRNYKTKFPAKAKVDLNKSKGKAKRIDIDRDLKGSRNGTLHPTEETEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVDADSSYFKIFKTKHD

SEQ ID NO: 847575 - protein, 339 aa, Homo sapiens; identical to SEQ ID NO: 847566

SEQ ID NO: 847576 - protein, 241 aa, Homo sapiens
EYPGDGGIIAASVGSSTGSHEAATKLSSRRFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVDADSSYFKIFKTKHD

SEQ ID NO: 847577 - protein, 168 aa, Homo sapiens
MNWELLLWLLVLCALLLLLVQLLRFLRADGDLTLLWAEWQGRRPGEDRPKPLPSGRPGSELPRRVRVSGGSAVIPGPLWVAWSFPKARLPLTQGLRVGEEEARAKKPLCLLYWSEDGMDLPFRLGNLSRECQTVKRALESAVLLRTLTSYAGLKGFWCCLRGRYFEKQ

SEQ ID NO: 847578 - protein, 563 aa, Homo sapiens
MWAVLRLALRPCARASPAGPRAYHGDSVASLGTQPDLGSALYQENYKQMKALVNQLHERVEHIKLGGGEKARALHISRGKLLPRERIDNLIDPGSPFLELSQFAGYQLYDNEEVPGGGIITGIGRVSGVECMIIANDATVKGGAYYPVTVKKQLRAQEIAMQNRLPCIYLVDSGGAYLPRQADVFPDRDHFGRTFYNQAIMSSKNIAQIAVVMGSCTAGGAYVPAMADENIIVRKQGTIFLAGPPLVKAATGEEVSAEDLGGADLHCRKSGVSDHWALDDHHALHLTRKVVRNLNYQKKLDVTIEPSEEPLFPADELYGIVGANLKRSFDVREVIARIVDGSRFTEFKAFYGDTLVTGFARIFGYPVGIVGNNGVLFSESAKKGTHFVQLCCQRNIPLLFLQNITGFMVGREYEAEGIAKDGAKMVAAVACAQVPKITLIIGGSYGAGNYGMCGRAYSPRFLYIWPNARISVMGGEQAANVLATITKDQRAREGKQFSSADEAALKEPIIKKFEEEGNPYYSSARVWDDGIIDPADTRLVLGLSFSAALNAPIEKTDFGIFRM

SEQ ID NO: 847579 - protein, 563 aa, Homo sapiens; identical to SEQ ID NO: 847578

SEQ ID NO: 847580 - protein, 563 aa, Homo sapiens; identical to SEQ ID NO: 847578

SEQ ID NO: 847581 - protein, 563 aa, Homo sapiens; identical to SEQ ID NO: 847578

SEQ ID NO: 847582 - protein, 525 aa, Homo sapiens
MWAVLRLALRPCARASPAGPRAYHGDSVASLGTQPDLGSALYQENYKQMKALVNQLHERVEHIKLGGGEKARALHISRGKLLPRERIDNLIDPGSPFLELSQFAGYQLYDNEEVPGGGIITGIGRVSGVECMIIANDATVKGGAYYPVTVKKQLRAQEIAMQNRLPCIYLVDSGGAYLPRQADVFPDRDHFGRTFYNQAIMSSKNIAQVKAATGEEVSAEDLGGADLHCRKSGVSDHWALDDHHALHLTRKVVRNLNYQKKLDVTIEPSEEPLFPADELYGIVGANLKRSFDVREVIARIVDGSRFTEFKAFYGDTLVTGFARIFGYPVGIVGNNGVLFSESAKKGTHFVQLCCQRNIPLLFLQNITGFMVGREYEAEGIAKDGAKMVAAVACAQVPKITLIIGGSYGAGNYGMCGRAYSPRFLYIWPNARISVMGGEQAANVLATITKDQRAREGKQFSSADEAALKEPIIKKFEEEGNPYYSSARVWDDGIIDPADTRLVLGLSFSAALNAPIEKTDFGIFRM

SEQ ID NO: 847583 - protein, 334 aa, Homo sapiens
NTADTSSPVAALTKGGPAKKMVPCLRTMMFSSAMAGTEAPPAVQEPMTTAICAPQQLTRKVVRNLNYQKKLDVTIEPSEEPLFPADELYGIVGANLKRSFDVREVIARIVDGSRFTEFKAFYGDTLVTGFARIFGYPVGIVGNNGVLFSESAKKGTHFVQLCCQRNIPLLFLQNITGFMVGREYEAEGIAKDGAKMVAAVACAQVPKITLIIGGSYGAGNYGMCGRAYSPRFLYIWPNARISVMGGEQAANVLATITKDQRAREGKQFSSADEAALKEPIIKKFEEEGNPYYSSARVWDDGIIDPADTRLVLGLSFSAALNAPIEKTDFGIFRM

SEQ ID NO: 847584 - protein, 358 aa, Homo sapiens
MWAVLRLALRPCARASPAGPRAYHGDSVASLGTQPDLGSALYQENYKQMKALVNQLHERVEHIKLGGGEKARALHISRGKLLPRERIDNLIDPGSPFLELSQFAGYQLYDNEEVPGGGIITGIGRVSGVECMIIANDATVKGGAYYPVTVKKQLRAQEIAMQNRLPCIYLVDSGGAYLPRQADVFPDRDHFGRTFYNQAIMSSKNIAQIAVVMGSCTAGGAYVPAMADENIIVRKQGTIFLAGPPLVKAATGEEVSAEDLGGADLHCRKSGVSDHWALDDHHALHLTRKVVRNLNYQKKLDVTIEPSEEPLFPADELYGIVGANLKRSFDVREVIARIVDGSRFTEFKAFYGDTLVTV

SEQ ID NO: 847585 - protein, 409 aa, Homo sapiens
MWAVLRLALRPCARASPAGPRAYHGDSVASLGTQPDLGSALYQENYKQMKALVNQLHERVEHIKLGGGEKARALHISRGKLLPRERIDNLIDPGSPFLELSQFAGYQLYDNEEVPGGGIITGIGRVSGVECMIIANDATVKGGAYYPVTVKKQLRAQEIAMQNRLPCIYLVDSGGAYLPRQADVFPDRDHFGRTFYNQAIMSSKNIAQIAVVMGSCTAGGAYVPAMADENIIVRKQGTIFLAGPPLVKAATGEEVSAEDLGGADLHCRKSGVSDHWALDDHHALHLTRKVVRNLNYQKKLDVTIEPSEEPLFPADELYGIVGANLKRSFDVREVIARIVDGSRFTEFKAFYGDTLVTGFARIFGYPVGIVGNNGVLFSESAKKVLTLSVMLPRNSSAVPQTYAEFEGTG

SEQ ID NO: 847586 - protein, 541 aa, Homo sapiens
MWAVLRLALRPCARASPAGPRAYHGDSVASLGTQPDLGSALYQENYKQMKALVNQLHERVEHIKLGGGEKARALHISRGKLLPRERIDNLIDPGSPFLELSQFAGYQLYDNEEVPGGGIITGIGRVSGVECMIIANDATVKGGAYYPVTVKKQLRAQEIAMQNRLPCIYLVDSGGAYLPRQADVFPDRDHFGRTFYNQAIMSSKNIAQVKAATGEEVSAEDLGGADLHCRKSGVSDHWALDDHHALHLTRKVVRNLNYQKKLDVTIEPSEEPLFPADELYGIVGANLKRSFDVREVIARIVDGSRFTEFKAFYGDTLVTALGKAQDINLFELSFDGFARIFGYPVGIVGNNGVLFSESAKKGTHFVQLCCQRNIPLLFLQNITGFMVGREYEAEGIAKDGAKMVAAVACAQVPKITLIIGGSYGAGNYGMCGRAYSPRFLYIWPNARISVMGGEQAANVLATITKDQRAREGKQFSSADEAALKEPIIKKFEEEGNPYYSSARVWDDGIIDPADTRLVLGLSFSAALNAPIEKTDFGIFRM

SEQ ID NO: 847587 - protein, 563 aa, Homo sapiens; identical to SEQ ID NO: 847578

SEQ ID NO: 847588 - protein, 563 aa, Homo sapiens; identical to SEQ ID NO: 847578

SEQ ID NO: 847589 - protein, 511 aa, Homo sapiens
ELRFKRGKASLHQRGGEKARALHISRGKLLPRERIDNLIDPGSPFLELSQFAGYQLYDNEEVPGGGIITGIGRVSGVECMIIANDATVKGGAYYPVTVKKQLRAQEIAMQNRLPCIYLVDSGGAYLPRQADVFPDRDHFGRTFYNQAIMSSKNIAQIAVVMGSCTAGGAYVPAMADENIIVRKQGTIFLAGPPLVKAATGEEVSAEDLGGADLHCRKSGVSDHWALDDHHALHLTRKVVRNLNYQKKLDVTIEPSEEPLFPADELYGIVGANLKRSFDVREVIARIVDGSRFTEFKAFYGDTLVTGFARIFGYPVGIVGNNGVLFSESAKKGTHFVQLCCQRNIPLLFLQNITGFMVGREYEAEGIAKDGAKMVAAVACAQVPKITLIIGGSYGAGNYGMCGRAYSPRFLYIWPNARISVMGGEQAANVLATITKDQRAREGKQFSSADEAALKEPIIKKFEEEGNPYYSSARVWDDGIIDPADTRLVLGLSFSAALNAPIEKTDFGIFRM

SEQ ID NO: 847590 - protein, 563 aa, Homo sapiens; identical to SEQ ID NO: 847578

SEQ ID NO: 847591 - protein, 482 aa, Homo sapiens
MWAVLRLALRPCARASPAGPRAYHGDSVASLGTQPDLGSALYQENYKQMKALVNQLHERVEHIKLGGGEKARALHISRGKLLPRERIDNLIDPGSPFLELSQFAGYQLYDNEEVPGGGIITGIGRVSGVECMIIANDATVKGGAYYPVTVKKQLRAQEIAMQNRLPCIYLVDSGGAYLPRQADVFPDRDHFGRTFYNQAIMSSKNIAQIAVVMGSCTAGGAYVPAMADENIIVRKQGTIFLAGPPLVKAATGEEVSAEDLGGADLHCRKSGVSDHWALDDHHALHLTRKVVRNLNYQKKLDVTIEPSEEPLFPADELYGIVGANLKRSFDVREVIARIVDGSRFTEFKAFYGDTLVTGFARIFGYPVGIVGNNGVLFSESAKKGTHFVQLCCQRNIPLLFLQNITGFMVGREYEAEGIAKDGAKMVAAVACAQVPKITLIIGGSYGAGNYGMCGRAYSFPTLCSCKTLSTSFVINSSFSYKH

SEQ ID NO: 847592 - protein, 248 aa, Homo sapiens
VRVSDDSCKTQCHAVTFALWELIEMLAISRNQKLLQAGEENQVLELLIHRDGEFQELMKLALNQGKIHHEMQVLEKEVEKRDSDIQQLQKQLKEAEQILATAVYQAKEKLKSIEKARKGAISSEEIIKYAHRISASNAVCAPLTWVPGDPRRPYPTDLEMRSGLLGQMNNPSTNGVNGHLPGDALAAGRLPDVLAPQYPWQSNDMSMNMLPPNHSSDFLLEPPGHNKENEDDVEIMSTDSSSSSSESD

SEQ ID NO: 847593 - protein, 249 aa, Homo sapiens
ATHLRQLALRVRRWRDSGENGCVFECGEKEKERLGGGLGVAGGNSTRERLLSALEDLEVLSRELIEMLAISRNQKLLQAGEENQVLELLIHRDGEFQELMKLALNQGKIHHEMQVLEKEVEKRDSDIQQLQKQLKEAEQILATAVYQAKEKLKSIEKARKEKKKKKKKLGGGLGLGKVFGNHGLGEGAQRVQGPGPKRTQRNRGQDKGPGSSPLKRAGEHEGVVKIPGDRRANGLFTGTRSAIWAPGGR

SEQ ID NO: 847594 - protein, 276 aa, Homo sapiens
PRTCVSSLCACAGGGTLGKMAASSSVAGGNSTRERLLSALEDLEVLSRELIEMLAISRNQKLLQAGEENQVLELLIHRDGEFQELMKLALNQGKIHHEMQVLEKEVEKRDSDIQQLQKQLKEAEQILATAVYQAKEKLKSIEKARKGAISSEEIIKYAHRISASNAVCAPLTWVPGDPRRPYPTDLEMRSGLLGQMNNPSTNGVNGHLPGDALAAGRLPDVLAPQYPWQSNDMSMNMLPPNHSSDFLLEPPGHNKENEDDVEIMSTDSSSSSSESD

SEQ ID NO: 847595 - protein, 248 aa, Homo sapiens
EGPGGDRAVLNRSSMCMCVVSLLARINQESQAISISMLRPASVLELLIHRDGEFQELMKLALNQGKIHHEMQVLEKEVEKRDSDIQQLQKQLKEAEQILATAVYQAKEKLKSIEKARKGAISSEEIIKYAHRISASNAVCAPLTWVPGDPRRPYPTDLEMRSGLLGQMNNPSTNGVNGHLPGDALAAGRLPDVLAPQYPWQSNDMSMNMLPPNHSSDFLLEPPGHNKENEDDVEIMSTDSSSSSSESD

SEQ ID NO: 847596 - protein, 183 aa, Homo sapiens
LAVLIFYRAGQVNGLVLAMVGTDKGKHRLSPYCLATAVYQAKEKLKSIEKARKGAISSEEIIKYAHRISASNAVCAPLTWVPGDPRRPYPTDLEMRSGLLGQMNNPSTNGVNGHLPGDALAAGRLPDVLAPQYPWQSNDMSMNMLPPNHSSDFLLEPPGHNKENEDDVEIMSTDSSSSSSESD

SEQ ID NO: 847597 - protein, 290 aa, Homo sapiens
ATHLRQLALRVRRWRDSGENGCVFECGEKEKERLGGGLGVAGGNSTRERLLSALEDLEVLSRELIEMLAISRNQKLLQAGEENQVLELLIHRDGEFQELMKLALNQGKIHHEMQVLEKEVEKRDSDIQQLQKQLKEAEQILATAVYQAKEKLKSIEKARKGAISSEEIIKYAHRISASNAVCAPLTWVPGDPRRPYPTDLEMRSGLLGQMNNPSTNGVNGHLPGDALAAGRLPDVLAPQYPWQSNDMSMNMLPPNHSSDFLLEPPGHNKENEDDVEIMSTDSSSSSSESD

SEQ ID NO: 847598 - protein, 225 aa, Homo sapiens
ATHLRQLALRVRRWRDSGENGCVFECGEKEKERLGGGLGVAGGNSTRERLLSALEDLEVLSRELIEMLAISRNQKLLQAGEENQVLELLIHRDGEFQELMKLALNQGKIHHEMQVLEKEVEKRDRDPRRPYPTDLEMRSGLLGQMNNPSTNGVNGHLPGDALAAGRLPDVLAPQYPWQSNDMSMNMLPPNHSSDFLLEPPGHNKENEDDVEIMSTDSSSSSSESD

SEQ ID NO: 847599 - protein, 290 aa, Homo sapiens; identical to SEQ ID NO: 847597

SEQ ID NO: 847600 - protein, 109 aa, Homo sapiens
MCSTELGSWDPRRPYPTDLEMRSGLLGQMNNPSTNGVNGHLPGDALAAGRLPDVLAPQYPWQSNDMSMNMLPPNHSSDFLLEPPGHNKENEDDVEIMSTDSSSSSSESD

SEQ ID NO: 847601 - protein, 78 aa, Homo sapiens
VRRRRSGWEAVWEWRVVTAHESGCCLRLRTWRSCLGNAASLRAGLELGRGTDPGAGRPCVCARSRGSAGRASSGVSGA

SEQ ID NO: 847602 - protein, 290 aa, Homo sapiens; identical to SEQ ID NO: 847597

SEQ ID NO: 847603 - protein, 290 aa, Homo sapiens; identical to SEQ ID NO: 847597

SEQ ID NO: 847604 - protein, 290 aa, Homo sapiens; identical to SEQ ID NO: 847597

SEQ ID NO: 847605 - protein, 254 aa, Homo sapiens
ATHLRQLALRVRRWRDSGENGCVFEWELIEMLAISRNQKLLQAGEENQVLELLIHRDGEFQELMKLALNQGKIHHEMQVLEKEVEKRDSDIQQLQKQLKEAEQILATAVYQAKEKLKSIEKARKGAISSEEIIKYAHRISASNAVCAPLTWVPGDPRRPYPTDLEMRSGLLGQMNNPSTNGVNGHLPGDALAAGRLPDVLAPQYPWQSNDMSMNMLPPNHSSDFLLEPPGHNKENEDDVEIMSTDSSSSSSESD

SEQ ID NO: 847606 - protein, 290 aa, Homo sapiens; identical to SEQ ID NO: 847597

SEQ ID NO: 847607 - protein, 248 aa, Homo sapiens; identical to SEQ ID NO: 847592

SEQ ID NO: 847608 - protein, 290 aa, Homo sapiens; identical to SEQ ID NO: 847597

SEQ ID NO: 847609 - protein, 167 aa, Homo sapiens
ATHLRQLALRVRRWRDSGENGCVFECGEKEKERLGGGLGVAGGNSTRERLLSALEDLEVLSRELIEMLAISRNQKLLQAGEENQVLELLIHRDGEFQELMKLALNQGKIHHEMQVLEKEVEKRDSDIQQLQKQLKEAEQILATAVYQAKEKLKSIEKARKVMLYVLH

SEQ ID NO: 847610 - protein, 143 aa, Homo sapiens
ATHLRQLALRVRRWRDSGENGCVFECGEKEKERLGGGLGVAGGNSTRERLLSALEDLEVLSRELIEMLAISRNQKLLQAGEENQVLELLIHRDGEFQELMKLALNQGKIHHEMQVLEKEVEKRDSDIQQLQKQLKEAEQILVS

SEQ ID NO: 847611 - protein, 67 aa, Homo sapiens
PCVVPGVLGLVLSGSATTIRLGPIPTTAVESAPFSDILRGIPAIWSNFVEPGLYENKSGLQSFQIPS

SEQ ID NO: 847612 - protein, 612 aa, Homo sapiens
MAAAGRLPSSWALFSPLLAGLALLGVGPVPARALHNVTAELFGAEAWGTLAAFGDLNSDKQTDLFVLRERNDLIVFLADQNAPYFKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTADLFLTTLNATTSTFQFEIWENLDGNFSVSTILEKPQNMMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSWSAKLYLTPSNIVLLTAIALIGVCVFILAIIGILHWQEKKADDREKRQEAHRFHFDAM

SEQ ID NO: 847613 - protein, 612 aa, Homo sapiens; identical to SEQ ID NO: 847612

SEQ ID NO: 847614 - protein, 545 aa, Homo sapiens
MAAAGRLPSSWALFSPLLAGLALLGVGPVPARALHNVTAELFGAEAWGTLAAFGDLNSDKQTDLFVLRERNDLIVFLADQNAPYFKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTADLFLTTLNATTSTFQFEIWENLDGNFSVSTILEKPQNMMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIPSQCPSKLECQTVSYTK

SEQ ID NO: 847615 - protein, 649 aa, Homo sapiens
MAAAGRLPSSWALFSPLLAGLALLGVGPVPARALHNVTAELFGAEAWGTLAAFGDLNSDKQTDLFVLRERNDLIVFLADQNAPYFKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTAESPSVSRLEIRILAHCNLRLLGSSDSSASASQVAGTTDLFLTTLNATTSTFQFEIWENLDGNFSVSTILEKPQNMMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSWSAKLYLTPSNIVLLTAIALIGVCVFILAIIGILHWQEKKADDREKRQEAHRFHFDAM

SEQ ID NO: 847616 - protein, 597 aa, Homo sapiens
MAAAGRLPSSWALFSPLLAGLALLGVGPVPARALHNVTAELNSDKQTDLFVLRERNDLIVFLADQNAPYFKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTADLFLTTLNATTSTFQFEIWENLDGNFSVSTILEKPQNMMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSWSAKLYLTPSNIVLLTAIALIGVCVFILAIIGILHWQEKKADDREKRQEAHRFHFDAM

SEQ ID NO: 847617 - protein, 585 aa, Homo sapiens
MISYSEINLQKQRYLKLPSDPFGVYNTYQTLRKRKTEETTASGNDLIVFLADQNAPYFKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTADLFLTTLNATTSTFQFEIWENLDGNFSVSTILEKPQNMMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSWSAKLYLTPSNIVLLTAIALIGVCVFILAIIGILHWQEKKADDREKRQEAHRFHFDAM

SEQ ID NO: 847618 - protein, 305 aa, Homo sapiens
MTPCQNLKTRVVIPGSILIPCSSETPQLGMAASAHQWDSLDPDPADLHKLNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSWSAKLYLTPSNIVLLTAIALIGVCVFILAIIGILHWQEKKADDREKRQEAHRFHFDAM

SEQ ID NO: 847619 - protein, 310 aa, Homo sapiens
MAAAGRLPSSWALFSPLLAGLALLGVGPVPARALHNVTAELFGAEAWGTLAAFGDLNSDKQTDLFVLRERNDLIVFLADQNAPYFKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTAAHLFLTTLNAHHQYLPARPYGQQLDGHTLCTTLLFGTKLHKMTGWLEPTRLVRTCSETAPMGTFNLPRGENRHCAKSATNRGKRADAWGKPT

SEQ ID NO: 847620 - protein, 612 aa, Homo sapiens; identical to SEQ ID NO: 847612

SEQ ID NO: 847621 - protein, 612 aa, Homo sapiens; identical to SEQ ID NO: 847612

SEQ ID NO: 847622 - protein, 612 aa, Homo sapiens; identical to SEQ ID NO: 847612

SEQ ID NO: 847623 - protein, 609 aa, Homo sapiens
MAAAGRLPSSWALFSPLLAGLALLGVGPVPARALHNVTAELFGAEAWGTLAAFGDLNSDKQTDLFVLRERNDLIVFLADQNAPYFKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTADLFLTTLNATTSTFQFEIWENLDGNFSVSTILEKPQNMMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSWSAKLYLTPSNIVLLTAIALIGVCVFILAIIGILHWQEKKAADTVCSREALGCLV

SEQ ID NO: 847624 - protein, 445 aa, Homo sapiens [sequence omitted]

SEQ ID NO: 847625 - protein, 414 aa, Homo sapiens
MAAAGRLPSSWALFSPLLAGLALLGVGPVPARALHNVTAELFGAEAWGTLAAFGDLNSDKQTDLFVLRERNDLIVFLADQNAPYFKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTADLFLTTLNATTSTFQFEIWENLDGNFSVSTILEKPQNMMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELRRVLVTSRLISFTPWNLPRSIIHPFNQ

SEQ ID NO: 847626 - protein, 143 aa, Homo sapiens
MYTTVDANGYLKNGSAGQLSQSAHLALQLPYNVLGLGRSANFLDHLYVGIPRPSGEKSIRKQEWTAIIPNSQLIVIPYPHNVPRSWSAKLYLTPSNIVLLTAIALIGVCVFILAIIGILHWQEKKADDREKRQEAHRFHFDAM

SEQ ID NO: 847627 - protein, 121 aa, Homo sapiens
CVKSGSAIEVVCIDKLDLGGMQQQQQLASARNRRLAQQMENRPSVQAALKLKQKSLKQRLGKSNIQARLGRPIGALARGAIGGRGLPIIQRGLPRGGLRGGRATRTLLRGGMSLRGQCCVP

SEQ ID NO: 847628 - protein, 249 aa, Homo sapiens
MAAQSAPKVVLKSTTKMSLNERFTNMLKNKQPTPVNIRASMQQQQQLASARNRRLAQQMENRPSVQAALKLKQKSLKQRLGKSNIQARLGRPIGALARGAIGGRGLPIIQRGLPRGGLRGGRATRTLLRGGMSLRGQNLLRGGRAVAPRMGLRRGGVRGRGGPGRGGLGRGAMGRGGIGGRGRGMIGRGRGGFGGRGRGRGRGRGALARPVLTKEQLDNQLDAYMSKTKGHLDAELDAYMAQTDPETND

SEQ ID NO: 847629 - protein, 249 aa, Homo sapiens; identical to SEQ ID NO: 847628

SEQ ID NO: 847630 - protein, 249 aa, Homo sapiens; identical to SEQ ID NO: 847628

SEQ ID NO: 847631 - protein, 258 aa, Homo sapiens
MAAQSAPKVVLKSTTKMSLNERFTNMLKNKQPTPVNIRASMQQQQQLASARNRRLAQQMENRPSVQAALKLKQKSLKQRLGKSNIQARLGRPIGALARGAIGGRGLPIIQRGLPRGGLRGGRATRTLLRGGMSLRGQNLLRGGRAVAPRMGLRRGGVRGRGGPGRGGLGRGAMGRGGIGGRGRGMIGRGRGGFGGRGRGRGRGRGALARPVLTKEQLDNQLDAYMSKTNEACPSSHERLLLVNTSVNNLEITDEKKSD

SEQ ID NO: 847632 - protein, 249 aa, Homo sapiens; identical to SEQ ID NO: 847628

SEQ ID NO: 847633 - protein, 313 aa, Homo sapiens
AGQTSTGRGGHFVLDTEQELAAAADERQERAGRVRPVPGPPAGAVVAAPGGALASVSFDSRDSKMAAQSAPKVVLKSTTKMSLNERFTNMLKNKQPTPVNIRASMQQQQQLASARNRRLAQQMENRPSVQAALKLKQKSLKQRLGKSNIQARLGRPIGALARGAIGGRGLPIIQRGLPRGGLRGGRATRTLLRGGMSLRGQNLLRGGRAVAPRMGLRRGGVRGRGGPGRGGLGRGAMGRGGIGGRGRGMIGRGRGGFGGRGRGRGRGRGALARPVLTKEQLDNQLDAYMSKTKGHLDAELDAYMAQTDPETND

SEQ ID NO: 847634 - protein, 217 aa, Homo sapiens
MMILVFSAVQQQQQLASARNRRLAQQMENRPSVQAALKLKQKSLKQRLGKSNIQARLGRPIGALARGAIGGRGLPIIQRGLPRGGLRGGRATRTLLRGGMSLRGQNLLRGGRAVAPRMGLRRGGVRGRGGPGRGGLGRGAMGRGGIGGRGRGMIGRGRGGFGGRGRGRGRGRGALARPVLTKEQLDNQLDAYMSKTKGHLDAELDAYMAQTDPETND

SEQ ID NO: 847635 - protein, 118 aa, Homo sapiens
MSLRGQNLLRGGRAVAPRMGLRRGGVRGRGGPGRGGLGRGAMGRGGIGGRGRGMIGRGRGGFGGRGRGRGRGRGALARPVLTKEQLDNQLDAYMSKTKGHLDAELDAYMAQTDPETND

SEQ ID NO: 847636 - protein, 118 aa, Homo sapiens; identical to SEQ ID NO: 847635

SEQ ID NO: 847637 - protein, 141 aa, Homo sapiens
MAAQSAPKVVLKSTTKMSLNERFTNMLKNKQPTPVNIRASMQQQQQLASARNRRLAQQMENRPSVQAALKLKQKSLKQRLGKSNIQARLGRPIGALARGAIGGRGLPIIQRGLPRGGLRGGRATRTLLRGGMSLRGQCCVP

SEQ ID NO: 847638 - protein, 66 aa, Homo sapiens
VDYYYKFAAASTRGRGRGRGRGALARPVLTKEQLDNQLDAYMSKTKGHLDAELDAYMAQTDPETND

SEQ ID NO: 847639 - protein, 249 aa, Homo sapiens; identical to SEQ ID NO: 847628

SEQ ID NO: 847640 - protein, 224 aa, Homo sapiens
MLKNKQPTPVNIRASMQQQQQLASARNRRLAQQMENRPSVQAALKLKQKSLKQRLGKSNIQARLGRPIGALARGAIGGRGLPIIQRGLPRGGLRGGRATRTLLRGGMSLRGQNLLRGGRAVAPRMGLRRGGVRGRGGPGRGGLGRGAMGRGGIGGRGRGMIGRGRGGFGGRGRGRGRGRGALARPVLTKEQLDNQLDAYMSKTKGHLDAELDAYMAQTDPETND

SEQ ID NO: 847641 - protein, 204 aa, Homo sapiens
MDDCKVAQGKKLKLLWKKEKFREFQFWQKSLKQRLGKSNIQARLGRPIGALARGAIGGRGLPIIQRGLPRGGLRGGRATRTLLRGGMSLRGQNLLRGGRAVAPRMGLRRGGVRGRGGPGRGGLGRGAMGRGGIGGRGRGMIGRGRGGFGGRGRGRGRGRGALARPVLTKEQLDNQLDAYMSKTKGHLDAELDAYMAQTDPETND

SEQ ID NO: 847642 - protein, 204 aa, Homo sapiens; identical to SEQ ID NO: 847641

SEQ ID NO: 847643 - protein, 190 aa, Homo sapiens
MAAQSAPKVVLKSTTKMSLNERFTNMLKNKQPTPVNIRASMQQQQQLASARNRRLAQQMENRPSVQAALKLKQKSLKQRLGKSNIQARLGRPIGALARGAIGGRGLPIIQRGLPRGGLRGGRATRTLLRGGMSLRGQNLLRGGRAVAPRMGLRRGGVRGRGGPGRGGLGRGAMGRGGIGGRAAYDRSEKT

SEQ ID NO: 847644 - protein, 158 aa, Homo sapiens
AGQTSTGRGGHFVLDTEQELAAAADERQERAGRVSRRIGRLDSQRQNLLRGGRAVAPRMGLRRGGVRGRGGPGRGGLGRGAMGRGGIGGRGRGMIGRGRGGFGGRGRGRGRGRGALARPVLTKEQLDNQLDAYMSKTKGHLDAELDAYMAQTDPETND

SEQ ID NO: 847645 - protein, 141 aa, Homo sapiens; identical to SEQ ID NO: 847637

SEQ ID NO: 847646 - protein, 357 aa, Homo sapiens
MAAQSAPKVVLKSTTKMSLNERFTNMLKNKQPTPVNIRASMQQQQQLASARNRRLAQQMENRPSVQAALKLKQKSLKQRLGKSNIQARLGRPIGALARGAIGGRGLPIIQRGLPRGGLRGGRATRTLLRGGMSLRGGVRGRGGPGRGGLGRGAMGRGGIGGRAAYDRSEKRGLRGPLSSSVAGGALPLLPRSRSWSSLPFRWLSLCPPRLVASPAARSPPRLAPSPAPRPRPALLSRPLLPAWLSPRPLPPPSPPPSPRSSPFLRSLFPALRCRAPSGPFPGLCSLAHAFSPSLAPRRSFVRGFAFSSRPPPARASCLLFVPGASPCALLGRLPLPVPSRFAVSSTPSSSSSASPSA

SEQ ID NO: 847647 - protein, 357 aa, Homo sapiens
MAAQSAPKVVLKSTTKMSLNERFTNMLKNKQPTPVNIRASMQQQQQLASARNRRLAQQMENRPSVQAALKLKQKSLKQRLGKSNIQARLGRPIGALARGAIGGRGLPIIQRGLPRGGLRGGRATRTLLRGGMSLRGGVRGRGGPGRGGLGRGAMGRGGIGGRAAYDTSFKMPFATPLLSHGRLSIPPRPPSLCPPRSAPPRPLLVRSSVRSPARSLSLRPLSPPSPPSLALLLRLLSLHPRSSPPLLGILSAAASLPLRPPHLFRPSAFLCLPLHSLSPLTSTPASARSTSSPLALSALSPPALAPSPPPLPPRFGRLLSASSTRVARRRSPLPPLPPLRPGVLVAPPRSVPSAASR

SEQ ID NO: 847648 - protein, 95 aa, Homo sapiens
MRRNLIDAGWTYHNRLWTYLPPACAFSVFLLLFDTVLYETLLSFDLVFCFCFFRGEGGFPLLCPDFSLNTNALALWLEHPLPTSVSPHLSYALTC

SEQ ID NO: 847649 - protein, 141 aa, Homo sapiens
MKDNKIMNNQDAIEKAVSRGQCLYKISSYTSYPMHDFYRCHTCNTTDRNAICVNCIKKCHQGHDVEFIRHDRYVAHLLDILPNYFPPHFSNIWVSFCFRFFCDCGAGTLSNPCTLAGEPTHDTDTLYDSAPPIESNTLQHN

SEQ ID NO: 847650 - protein, 927 aa, Homo sapiens
MNSVRAANRRPRRVSRPRPVQQQQQQPPQQPPPQPPQQQPPQQQPPPPPQQQQQQQPPPPPPPPPPLPQERNNVGERDDDVPADMVAEESGPGAQNSPYQLRRKTLLPKRTACPTKNSMEGASTSTTENFGHRAKRARVSGKSQDLSAAPAEQYLQEKLPDEVVLKIFSYLLEQDLCRAACVCKRFSELANDPNLWKRLYMEVFEYTRPMMHPEPGKFYQINPEEYEHPNPWKESFQQLYKGAHVKPGFAEHFYSNPARYKGRENMLYYDTIEDALGGVQEAHFDGLIFVHSGIYTDEWIYIESPITMIGAAPGKVADKVIIENTRDSTFVFMEGSEDAYVGYMTIRFNPDDKSAQHHNAHHCLEITVNCSPIIDHCIIRSTCTVGSAVCVSGQGACPTIKHCNISDCENVGLYITDHAQGIYEDNEISNNALAGIWVKNHGNPIIRRNHIHHGRDVGVFTFDHGMGYFESCNIHRNRIAGFEVKAYANPTVVRCEIHHGQTGGIYVHEKGRGQFIENKIYANNFAGVWITSNSDPTIRGNSIFNGNQGGVYIFGDGRGLIEGNDIYGNALAGIQIRTNSCPIVRHNKIHDGQHGGIYVHEKGQGVIEENEVYSNTLAGVWVTTGSTPVLRRNRIHSGKQVGVYFYDNGHGVLEDNDIYNHMYSGVQIRTGSNPKIRRNKIWGGQNGGILVYNSGLGCIEDNEIFDNAMAGVWIKTDSNPTLRRNKIHDGRDGGICIFNGGRGLLEENDIFRNAQAGVLISTNSHPILRKNRIFDGFAAGIEITNHATATLEGNQIFNNRFGGLFLASGVNVTMKDNKIMNNQDAIEKAVSRGQCLYKISSYTSYPMHDFYRCHTCNTTDRNAICVNCIKKCHQGHDVEFIRHDRFFCDCGAGTLSNPCTLAGEPTHDTDTLYDSAPPIESNTLQHN

SEQ ID NO: 847651 - protein, 927 aa, Homo sapiens; identical to SEQ ID NO: 847650

SEQ ID NO: 847652 - protein, 927 aa, Homo sapiens; identical to SEQ ID NO: 847650

SEQ ID NO: 847653 - protein, 927 aa, Homo sapiens; identical to SEQ ID NO: 847650

SEQ ID NO: 847654 - protein, 903 aa, Homo sapiens
MNSVRAANRRPRRVSRPRPVQQQQQQPPQQPPPQPPQQQPPQQQPPPPPQQQQQQQPPPPPPPPPPLPQERNNVGERDDDVPADMVAEESGPGAQNSPYQLRRKTLLPKRTACPTKNSMEGASTSTTENFGHRAKRARVSGKSQDLSAAPAEQYLQEKLPDEVVLKIFSYLLEQDLCRAACVCKRFSELANDPNLWKRLYMEVFEYTRPMMHPEPGKFYQINPEEYEHPNPWKESFQQLYKGAHVKPGFAEHFYSNPARYKGRENMLYYDTIEDALGGVQEAHFDGLIFVHSGIYTDEWIYIESPITMIGAAPGKVADKVIIENTRDSTFVFMEGSEDAYVGYMTIRFNPDDKSAQHHNAHHCLEITVNCSPIIDHCIIRSTCTVGSAVCVSGQGACPTIKHCNISDCENVGLYITDHAQGIYEDNEISNNALAGIWVKNHGNPIIRRNHIHHGRDVGVFTFDHGMGYFESCNIHRNRIAGFEVKAYANPTVVRCEIHHGQTGGIYVHEKGRGQFIENKIYANNFAGVWITSNSDPTIRGNSIFNGNQGGVYIFGDGRGLIEGNDIYGNALAGIQIRTNSCPIVRHNKIHDGQHGGIYVHEKGQGVIEENEVYSNTLAGVWVTTGSTPVLRRNRIHSGKQVGVYFYDNGHGVLEDNDIYNHMYSGVQIRTGSNPKIRRNKIWGGQNGGILVYNSGLGCIEDNEIFDNAMAGVWIKTDSNPTLRRNKIHDGRDGGICIFNGGRGLLEENDIFRNAQAGVLISTNSHPILRKNRIFDGFAAGIEITNHATATLEGNQIFNNRFGGLFLASGVNVTMKDNKIMNNQDAIEKAVSRGQCLYKISSYTSYPMHDFYRCHTCNTTDRNAICVNCIKKCHQGHDVEFIRHDRFFCDCGAGTLSNPCTLAG

SEQ ID NO: 847655 - protein, 204 aa, Homo sapiens
MNSVRAANRRPRRVSRPRPVQQQQQQPPQQPPPQPPQQQPPQQQPPPPPQQQQQQQPPPPPPPPPPLPQERNNVGERDDDVPADMVAEESGPGAQNSPYQLRRKTLLPKRTACPTKNSMEGASTSTTENFGHRAKRARVSGKSQDLSAAPAEQYLQEKLPDEVVLKIFSYLLEQDLCRAACVCKRFSELANDPNFVARRSGSRL

SEQ ID NO: 847656 - protein, 909 aa, Homo sapiens
MNSVRAANRRPRRVSRPRPVQQQQQQPPQQPPPQPPQQQPPQQQPPPPPQQQQQQQPPPPPPPPPPLPQERNNVGERDDDVPADMVAEESGPGAQNSPYQLRRKTLLPKRTACPTKNSMEGASTSTTENFGHRAKRARVSGKSQDLSAAPAEQYLQEKLPDEVVLKIFSYLLEQDLCRAACVCKRFSELANDPNLWKRLYMEVFEYTRPMMHPEPGKFYQINPEEYEHPNPWKESFQQLYKGAHVKPGFAEHFYSNPARYKGRENMLYYDTIEDALGGVQEAHFDGLIFVHSGIYTDEWIYIESPITMIGAAPGKVADKVIIVGLYDNKFNPDDKSAQHHNAHHCLEITVNCSPIIDHCIIRSTCTVGSAVCVSGQGACPTIKHCNISDCENVGLYITDHAQGIYEDNEISNNALAGIWVKNHGNPIIRRNHIHHGRDVGVFTFDHGMGYFESCNIHRNRIAGFEVKAYANPTVVRCEIHHGQTGGIYVHEKGRGQFIENKIYANNFAGVWITSNSDPTIRGNSIFNGNQGGVYIFGDGRGLIEGNDIYGNALAGIQIRTNSCPIVRHNKIHDGQHGGIYVHEKGQGVIEENEVYSNTLAGVWVTTGSTPVLRRNRIHSGKQVGVYFYDNGHGVLEDNDIYNHMYSGVQIRTGSNPKIRRNKIWGGQNGGILVYNSGLGCIEDNEIFDNAMAGVWIKTDSNPTLRRNKIHDGRDGGICIFNGGRGLLEENDIFRNAQAGVLISTNSHPILRKNRIFDGFAAGIEITNHATATLEGNQIFNNRFGGLFLASGVNVTMKDNKIMNNQDAIEKAVSRGQCLYKISSYTSYPMHDFYRCHTCNTTDRNAICVNCIKKCHQGHDVEFIRHDRFFCDCGAGTLSNPCTLAGEPTHDTDTLYDSAPPIESNTLQHN

SEQ ID NO: 847657 - protein, 927 aa, Homo sapiens; identical to SEQ ID NO: 847650

SEQ ID NO: 847658 - protein, 770 aa, Homo sapiens
MNSVRAANRRPRRVSRPRPVQQQQQQPPQQPPPQPPQQQPPQQQPPPPPQQQQQQQPPPPPPPPPPLPQERNNVGERDDDVPADMVAEESGPGAQNSPYQLRRKTLLPKRTACPTKNSMEGASTSTTENFGHRAKRARVSGKSQDLSAAPAEQYLQEKLPDEVVLKIFSYLLEQDLCRAACVCKRFSELANDPNLWKRLYMEVFEYTRPMMHPEPGKFYQINPEEYEHPNPWKESFQQLYKGAHVKPGFAEHFYSNPARYKGRENMLYYDTIEDALGGVQEAHFDGLIFVHSGIYTDEWIYIESPITMIGAAPGKVADKVIIENTRDSTFVFMEGSEDAYVGYMTIRFNPDDKSAQHHNAHHCLEITVNCSPIIDHCIIRSTCTVGSAVCVSGQGACPTIKHCNISDCENVGLYITDHAQGIYEDNEISNNALAGIWVKNHGNPIIRRNHIHHGRDVGVFTFDHGMGYFESCNIHRNRIAGFEVKAYANPTVVRCEIHHGQTGGIYVHEKGRGQFIENKIYANNFAGVWITSNSDPTIRGNSIFNGNQGGVYIFGDGRGLIEGNDIYGNALAGIQIRTNSCPIVRHNKIHDGQHGGIYVHEKGQGVIEENEVYSNTLAGVWVTTGSTPVLRRNRIHSGKQVGVYFYDNGHGVLEDNDIYNHMYSGVQIRTGSNPKIRRNKIWGGQNGGILVYNSGLGCIEDNEIFDNAMAGVWIKTDSNPTLRRNKIHDGRDGGICIFNGGRGIVVNFALVKNPVFHYSSISLMINDIAN

SEQ ID NO: 847659 - protein, 669 aa, Homo sapiens
MNSVRAANRRPRRVSRPRPVQQQQQQPPQQPPPQPPQQQPPQQQPPPPPQQQQQQQPPPPPPPPPPLPQERNNVGERDDDVPADMVAEESGPGAQNSPYQLRRKTLLPKRTACPTKNSMEGASTSTTENFGHRAKRARVSGKSQDLSAAPAEQYLQEKLPDEVVLKIFSYLLEQDLCRAACVCKRFSELANDPNLWKRLYMEVFEYTRPMMHPEPGKFYQINPEEYEHPNPWKESFQQLYKGAHVKPGFAEHFYSNPARYKGRENMLYYDTIEDALGGVQEAHFDGLIFVHSGIYTDEWIYIESPITMIGAAPGKVADKVIIENTRDSTFVFMEGSEDAYVGYMTIRFNPDDKSAQHHNAHHCLEITVNCSPIIDHCIIRSTCTVGSAVCVSGQGACPTIKHCNISDCENVGLYITDHAQGIYEDNEISNNALAGIWVKNHGNPIIRRNHIHHGRDVGVFTFDHGMGYFESCNIHRNRIAGFEVKAYANPTVVRCEIHHGQTGGIYVHEKGRGQFIENKIYANNFAGVWITSNSDPTIRGNSIFNGNQGGVYIFGDGRGLIEGNDIYGNALAGIQIRTNSCPIVRHNKIHDGQHGGIYVHEKGQGVIEENEVYSNTLAGVWVTTGSTPVLRRNRIHSGKQVGVYFYDNGHGVLEDNDIYNHMYSGVQIR

SEQ ID NO: 847660 - protein, 441 aa, Homo sapiens
MNSVRAANRRPRRVSRPRPVQQQQQQPPQQPPPQPPQQQPPQQQPPPPPQQQQQQQPPPPPPPPPPLPQERNNVGERDDDVPADMVAEESGPGAQNSPYQLRRKTLLPKRTACPTKNSMEGASTSTTENFGHRAKRARVSGKSQDLSAAPAEQYLQEKLPDEVVLKIFSYLLEQDLCRAACVCKRFSELANDPNLWKRLYMEVFEYTRPMMHPEPGKFYQINPEEYEHPNPWKESFQQLYKGAHVKPGFAEHFYSNPARYKGRENMLYYDTIEDALGGVQEAHFDGLIFVHSGIYTDEWIYIESPITMIGAAPGKVADKVIIENTRDSTFVFMEGSEDAYVGYMTIRFNPDDKSAQHHNAHHCLEITVNCSPIIDHCIIRSTCTVGSAVCVSGQGACPTIKHCNISDCENVGLYITDHAQGIYEDNEISNNALAGICVVSH

SEQ ID NO: 847661 - protein, 159 aa, Homo sapiens
MNSVRAANRRPRRVSRPRPVQQQQQQPPQQPPPQPPQQQPPQQQPPPPPQQQQQQQPPPPPPPPPPLPQERNNVGERDDDVPADMVAEESGPGAQNSPYQLRRKTLLPKRTACPTKNSMEGASTSTTENFGHRAKRARVSGKSQDLSGISCGKVTNRVK

SEQ ID NO: 847662 - protein, 167 aa, Homo sapiens
MATEVHNLQELRRSASLATKVFIQRDYSDGTICQFQTKFPPELDSRIERQLFEETVKTLNGFYAEAEKIGGSSYLEGCLACATAYFIFLCMETHYEKVLKKISRYIQEQNEKIFAPRGLLLTDPVERGMRVIEISIYEDRCSSGSSSSGSSSGSGSSSGGGGGAGAR

SEQ ID NO: 847663 - protein, 167 aa, Homo sapiens; identical to SEQ ID NO: 847662

SEQ ID NO: 847664 - protein, 167 aa, Homo sapiens; identical to SEQ ID NO: 847662

SEQ ID NO: 847665 - protein, 305 aa, Homo sapiens
MASRKENAKSANRVLRISQLDALELNKALEQLVWSQFTQCFHGFKPGLLARFEPEVKACLWVFLWRFTIYSKNATVGQSVLNIKYKNDFSPNLRYQPPSKNQKIWYAVCTIGGRWLEERCYDLFRNHHLASFGKVKQCVNFVIGLLKLGGLINFLIFLQRGKFATLTERLLGIHSVFCKPQNIREVGFEYMNRELLWHGFAEFLIFLLPLINVQKLKAKLSSWCIPLTGAPNSDNTLATSGKECALCGEWPTMPHTIGCEHIFCYFCAKSSFLFDVYFTCPKCGTEVHSLQPLKSGIEMSEVNAL

SEQ ID NO: 847666 - protein, 305 aa, Homo sapiens; identical to SEQ ID NO: 847665

SEQ ID NO: 847667 - protein, 305 aa, Homo sapiens; identical to SEQ ID NO: 847665

SEQ ID NO: 847668 - protein, 305 aa, Homo sapiens; identical to SEQ ID NO: 847665

SEQ ID NO: 847669 - protein, 305 aa, Homo sapiens; identical to SEQ ID NO: 847665

SEQ ID NO: 847670 - protein, 305 aa, Homo sapiens; identical to SEQ ID NO: 847665

SEQ ID NO: 847671 - protein, 305 aa, Homo sapiens; identical to SEQ ID NO: 847665

SEQ ID NO: 847672 - protein, 499 aa, Homo sapiens
MAQFAFESDLHSLLQLDAPIPNAPPARWQRKAKEAAGPAPSPMRAANRSHSAGRTPGRTPGKSSSKVQTTPSKPGGDRYIPHRSAAQMEVASFLLSKENQPENSQTPTKKEHQKAWALNLNGFDVEEAKILRLSGKPQNAPEGYQNRLKVLYSQKATPGSSRKTCRYIPSLPDRILDAPEIRNDYYLNLVDWSSGNVLAVALDNSVYLWSASSGDILQLLQMEQPGEYISSVAWIKEGNYLAVGTSSAEVQLWDVQQQKRLRNMTSHSARVGSLSWNSYILSSGSRSGHIHHHDVRVAEHHVATLSGHSQEVCGLRWAPDGRHLASGGNDNLVNVWPSAPGEGGWVPLQTFTQHQGAVKAVAWCPWQSNVLATGGGTSDRHIRIWNVCSGACLSAVDAHSQVCSILWSPHYKELISGHGFAQNQLVIWKYPTMAKVAELKGHTSRVLSLTMSPDGATVASAAADETLRLWRCFELDPARRREREKASAAKSSLIHQGIR

SEQ ID NO: 847673 - protein, 499 aa, Homo sapiens; identical to SEQ ID NO: 847672

SEQ ID NO: 847674 - protein, 499 aa, Homo sapiens; identical to SEQ ID NO: 847672

SEQ ID NO: 847675 - protein, 499 aa, Homo sapiens; identical to SEQ ID NO: 847672

SEQ ID NO: 847676 - protein, 499 aa, Homo sapiens; identical to SEQ ID NO: 847672

SEQ ID NO: 847677 - protein, 548 aa, Homo sapiens
MAQFAFESDLHSLLQLDAPIPNAPPARWQRKAKEAAGPAPSPMRAANRSHSAGRTPGRTPGKSSSKVQTTPSKPGGDRYIPHRSAAQMEVASFLLSKENQPENSQTPTKKEHQKAWALNLNGFDVEEAKILRLSGKPQNAPEGKTRSSWFLEGGVSSSPGLSTDICLLFLSKIEGKGGVDFPSVYTHSVATGYQNRLKVLYSQKATPGSSRKTCRYIPSLPDRILDAPEIRNDYYLNLVDWSSGNVLAVALDNSVYLWSASSGDILQLLQMEQPGEYISSVAWIKEGNYLAVGTSSAEVQLWDVQQQKRLRNMTSHSARVGSLSWNSYILSSGSRSGHIHHHDVRVAEHHVATLSGHSQEVCGLRWAPDGRHLASGGNDNLVNVWPSAPGEGGWVPLQTFTQHQGAVKAVAWCPWQSNVLATGGGTSDRHIRIWNVCSGACLSAVDAHSQVCSILWSPHYKELISGHGFAQNQLVIWKYPTMAKVAELKGHTSRVLSLTMSPDGATVASAAADETLRLWRCFELDPARRREREKASAAKSSLIHQGIR

SEQ ID NO: 847678 - protein, 306 aa, Homo sapiens
MAQFAFESDLHSLLQLDAPIPNAPPARWQRKAKEAAGPAPSPMRAANRSHSAGRTPGRTPGKSSSKVQTTPSKPGGDRYIPHRSAAQMEVASFLLSKENQPENSQTPTKKEHQKAWALNLNGFDVEEAKILRLSGKPQNAPEGYQNRLKVLYSQKATPGSSRKTCRYIPSLPDRILDAPEIRNDYYLNLVDWSSGNVLAVALDNSVYLWSASSGDILQLLQMEQPGEYISSVAWIKEGNYLAVGTSSAEVQLWDVQQQKRLRNMTSHSARVGSLSWNSYILSRSHIPGPESDHEPRWGHSGIRSSR

SEQ ID NO: 847679 - protein, 151 aa, Homo sapiens
VPVDQHQGAAKAVAWCPWQSNVLATGGGTSDRHIRIWNVCSGACLSAVDAHSQVCSILWSPHYKELISGHGFAQNQLVIWKYPTMAKVAELKGHTSRVLSLTMSPDGATVASAAADETLRLWRCFELDPARRREREKASAAKSSLIHQGIR

SEQ ID NO: 847680 - protein, 189 aa, Homo sapiens
EPRWGRGQGEGVLGRKGLQPRVALILWPARSEGVPFCPLSTVASFPPGLRRHQLQGPLPLRALPWHSSRSRVTCTRCFSWMHPSPMHPLRAGSAKPRKPQARPPHPCGPPTDPTAPAGLRAELLVSEVPKELSESSLHTFSLGSLVRLSSLSPPQANPVPRFRPLLANLAVTAISPIAVLPRWRWPASS

SEQ ID NO: 847681 - protein, 499 aa, Homo sapiens; identical to SEQ ID NO: 847672

SEQ ID NO: 847682 - protein, 499 aa, Homo sapiens; identical to SEQ ID NO: 847672

SEQ ID NO: 847683 - protein, 499 aa, Homo sapiens; identical to SEQ ID NO: 847672

SEQ ID NO: 847684 - protein, 499 aa, Homo sapiens; identical to SEQ ID NO: 847672

SEQ ID NO: 847685 - protein, 501 aa, Homo sapiens
HPQCTPCALGMGASRVKLDAPIPNAPPARWQRKAKEAAGPAPSPMRAANRSHSAGRTPGRTPGKSSSKVQTTPSKPGGDRYIPHRSAAQMEVASFLLSKENQPENSQTPTKKEHQKAWALNLNGFDVEEAKILRLSGKPQNAPEGYQNRLKVLYSQKATPGSSRKTCRYIPSLPDRILDAPEIRNDYYLNLVDWSSGNVLAVALDNSVYLWSASSGDILQLLQMEQPGEYISSVAWIKEGNYLAVGTSSAEVQLWDVQQQKRLRNMTSHSARVGSLSWNSYILSSGSRSGHIHHHDVRVAEHHVATLSGHSQEVCGLRWAPDGRHLASGGNDNLVNVWPSAPGEGGWVPLQTFTQHQGAVKAVAWCPWQSNVLATGGGTSDRHIRIWNVCSGACLSAVDAHSQVCSILWSPHYKELISGHGFAQNQLVIWKYPTMAKVAELKGHTSRVLSLTMSPDGATVASAAADETLRLWRCFELDPARRREREKASAAKSSLIHQGIR

SEQ ID NO: 847686 - protein, 436 aa, Homo sapiens
MAQFAFESDLHSLLQLDAPIPNAPPARWQRKAKEAAGPAPSPMRAANRSHSAGRTPGRTPGKSSSKVQTTPSKPGGDRYIPHRSAAQMEVASFLLSKENQPENSQTPTKKEHQKAWALNLNGFDVEEAKILRLSGKPQNAPEGYQNRLKVLYSQKATPGSSRKTCRYIPSLPDRILDAPEIRNDYYLNLVDWSSGNVLAVALDNSVYLWSASSGDILQLLQMEQPGEYISSVAWIKEGNYLAVGTSSAEVQLWDVQQQKRLRNMTSHSARVGSLSWNSYILSSGSRSGHIHHHDVRVAEHHVATLSGHSQEVCGLRWAPDGRHLASGGNDNLVNVWPSAPGEGGWVPLQTFTQHQGAVKAVAWCPWQSNVLATGGGTSDRHIRIWNVCSGACLSAVDAHSQVCSILWSPHYKESHIPGPESDHEPRWGHSGIRSSR

SEQ ID NO: 847687 - protein, 151 aa, Homo sapiens
SPYRPANSGGHAVAWCPWQSNVLATGGGTSDRHIRIWNVCSGACLSAVDAHSQVCSILWSPHYKELISGHGFAQNQLVIWKYPTMAKVAELKGHTSRVLSLTMSPDGATVASAAADETLRLWRCFELDPARRREREKASAAKSSLIHQGIR

SEQ ID NO: 847688 - protein, 115 aa, Homo sapiens [sequence omitted]

SEQ ID NO: 847689 - protein, 125 aa, Homo sapiens
AAEGDRDLVCSPLPSWSSGNPGPTENQSPEEMSQDKGLTCLSSSCGVTWSVAPTTPTSIPSVGETELIPLDSLVPEMCAPLLKDSHCKDEKPEGYTGEAEGSWCTGNGPWESSFCGLVQPQIPMF

SEQ ID NO: 847690 - protein, 816 aa, Homo sapiens
MGDTVVEPAPLKPTSEPTSGPPGNNGGSLLSVITEGVGELSVIDPEVAQKACQEVLEKVKLLHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLQCALLLGAYSSDMHISTQRHSRGTKLRKLILSDELKPAHRKRELPSLSPAPDTGLSPSKRTHQRSKSDATASISLSSNLKRTASNPKVENEDEELSSSTESIDNSFSSPVRLAPEREFIKSLMAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKRDPEDPSAVALKEPWQEKVRRIREGSPYGHLPNWRLLSVIVKCGDDLRQELLAFQVLKQLQSIWEQERVPLWIKPYKILVISADSGMIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGSQLPCFHGSSTIRNLKERFHMSMTEEQLQLLVEQMVDGSMRSITTKLYDGFQYLTNGIM

SEQ ID NO: 847691 - protein, 801 aa, Homo sapiens
MGDTVVEPAPLKPTSEPTSGPPGNNGGSLLSVITEGVGELSVIDPEVAQKACQEVLEKVKLLHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLQCALLLGAYSSDMHISTQRHSRGTKLRKLILSDELKPAHRKRELPSLSPAPDTGLSPSKRTHQRSKSDATASISLSSNLKRTASNPKVENEDEPVRLAPEREFIKSLMAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKRDPEDPSAVALKEPWQEKVRRIREGSPYGHLPNWRLLSVIVKCGDDLRQELLAFQVLKQLQSIWEQERVPLWIKPYKILVISADSGMIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGSQLPCFHGSSTIRNLKERFHMSMTEEQLQLLVEQMVDGSMRSITTKLYDGFQYLTNGIM

SEQ ID NO: 847692 - protein, 801 aa, Homo sapiens; identical to SEQ ID NO: 847691

SEQ ID NO: 847693 - protein, 801 aa, Homo sapiens; identical to SEQ ID NO: 847691

SEQ ID NO: 847694 - protein, 764 aa, Homo sapiens
MGDTVVEPAPLKPTSEPTSGPPGNNGGSLLSVITEGVGELSVIDPEVAQKACQEVLEKVKLLHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLQCALLLGAYSSDMHISTQRHSRGTKLRKLILSDELKPAHRKRELPSLSPAPDTGLSPSKRTHQRSKSDATASISLSSNLKRTASNPKVENEDEPVRLAPEREFIKSLMAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKRDPEDPSAVALKEPWQEKVRRIREGSPYGHLPNWRLLSVIVKCGDDLRQELLAFQVLKQLQSIWEQERVPLWIKPYKILVISADSGMIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGGAGVRSGAIVPQASPLSRSPGA

SEQ ID NO: 847695 - protein, 752 aa, Homo sapiens
MGDTVVEPAPLKPTSEPTSGPPGNNGGSLLSVITEGVGELSVIDPEVAQKACQEVLEKVKLLHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLQCALLLGAYSSDMHISTQRHSRGTKLRKLILSDELKPAHRKRELPSLSPAPDTGLSPSKRTHQRSKSDATASISLSSNLKRTASNPKVENEDEPVRLAPEREFIKSLMAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKRDPEDPSAVALKEPWQEKVRRIREGSPYGHLPNWRLLSVIVKCGDDLRQELLAFQVLKQLQSIWEQERVPLWIKPYKILVISADSGMIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVLSFLASMAPAPFETSKRGST

SEQ ID NO: 847696 - protein, 743 aa, Homo sapiens
APQRYQPDVNKVGGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLQCALLLGAYSSDMHISTQRHSRGTKLRKLILSDELKPAHRKRELPSLSPAPDTGLSPSKRTHQRSKSDATASISLSSNLKRTASNPKVENEDEPVRLAPEREFIKSLMAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKRDPEDPSAVALKEPWQEKVRRIREGSPYGHLPNWRLLSVIVKCGDDLRQELLAFQVLKQLQSIWEQERVPLWIKPYKILVISADSGMIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGSQLPCFHGSSTIRNLKERFHMSMTEEQLQLLVEQMVDGSMRSITTKLYDGFQYLTNGIM

SEQ ID NO: 847697 - protein, 509 aa, Homo sapiens
MNRPAWKLNEIPVRLAPEREFIKSLMAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKRDPEDPSAVALKEPWQEKVRRIREGSPYGHLPNWRLLSVIVKCGDDLRQELLAFQVLKQLQSIWEQERVPLWIKPYKILVISADSGMIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGSQLPCFHGSSTIRNLKERFHMSMTEEQLQLLVEQMVDGSMRSITTKLYDGFQYLTNGIM

SEQ ID NO: 847698 - protein, 344 aa, Homo sapiens
EQLFRKAPGMSPAAMNTGSLLLLAGDAVHRELGDVVTAVGIQCGEETAFKRDPEDPSAVALKEPWQEKVRRIREGSPYGHLPNWRLLSVIVKCGDDLRQELLAFQVLKQLQSIWEQERVPLWIKPYKILVISADSGMIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGSQLPCFHGSSTIRNLKERFHMSMTEEQLQLLVEQMVDGSMRSITTKLYDGFQYLTNGIM

SEQ ID NO: 847699 - protein, 145 aa, Homo sapiens
MAGDPPPWCHVASVLLLKVPASVRLTTASSSPLFPLLRHNGNILLDAEGHIIHIDFGFILSSSPRNLGFETSAFKLTTEFVDVMGGLDGDMFNYYKMLMLQGLIAARKHMDKVVQIVEIMQQGGAGVRSGAIVPQASPLSRSPGA

SEQ ID NO: 847700 - protein, 801 aa, Homo sapiens; identical to SEQ ID NO: 847691

SEQ ID NO: 847701 - protein, 657 aa, Homo sapiens
MGDTVVEPAPLKPTSEPTSGPPGNNGGSLLSVITEGVGELSVIDPEVAQKACQEVLEKVKLLHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLQCALLLGAYSSDMHISTQRHSRGTKLRKLILSDELKPAHRKRELPSLSPAPDTGLSPSKRTHQRSKSDATASISLSSNLKRTASNPKVENEDEPVRLAPEREFIKSLMAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKRDPEDPSAVALKEPWQEKVRRIREGSPYGHLPNWRLLSVIVKCGDDLRQELLAFQVLKQLQSIWEQERVPLWIKPYKILVISADSGMIEPVVNAVSIHQVKKQSQLSLLDYFLQEHGSYTTEAFLSAQRNFVQSCAGYCLVCYLLQVKDR

SEQ ID NO: 847702 - protein, 362 aa, Homo sapiens
MGDTVVEPAPLKPTSEPTSGPPGNNGGSLLSVITEGVGELSVIDPEVAQKACQEVLEKVKLLHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLQCALLLGAYSSDMHISTQRHSRGTKLRKLILSDELKPAHRKRELPSLSPAPDTGLSPSKRTHQRSKSDATASISLSSNLKRTASNPKVENEDEPVRLAPEREFIKSLMAIGKRLATLPTKEQKTQRLISELSLLNHKLEVSHSLISNYTTKL

SEQ ID NO: 847703 - protein, 229 aa, Homo sapiens
MGDTVVEPAPLKPTSEPTSGPPGNNGGSLLSVITEGVGELSVIDPEVAQKACQEVLEKVKLLHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLHVLSPASTPHCPSHRKREA

SEQ ID NO: 847704 - protein, 157 aa, Homo sapiens
MAGDPPPWCHVASVLLLKVPASVRLTTASSSPLFPLLRHNGNILLDAEGHIIHIDFGFILSSSPRNLGFETSAFKLTTEFVDVMGGLEEMTLAEKRGRVRVRALKATVKRNDSEGGAMVGDDTGREARAGVQATIPVAQEEPGHEQVRTVAQNIVEG

SEQ ID NO: 847705 - protein, 828 aa, Homo sapiens
MRFLEARSLAVAMGDTVVEPAPLKPTSEPTSGPPGNNGGSLLSVITEGVGELSVIDPEVAQKACQEVLEKVKLLHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLQCALLLGAYSSDMHISTQRHSRGTKLRKLILSDELKPAHRKRELPSLSPAPDTGLSPSKRTHQRSKSDATASISLSSNLKRTASNPKVENEDEELSSSTESIDNSFSSPVRLAPEREFIKSLMAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKRDPEDPSAVALKEPWQEKVRRIREGSPYGHLPNWRLLSVIVKCGDDLRQELLAFQVLKQLQSIWEQERVPLWIKPYKILVISADSGMIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGSQLPCFHGSSTIRNLKERFHMSMTEEQLQLLVEQMVDGSMRSITTKLYDGFQYLTNGIM

SEQ ID NO: 847706 - protein, 801 aa, Homo sapiens; identical to SEQ ID NO: 847691

SEQ ID NO: 847707 - protein, 828 aa, Homo sapiens; identical to SEQ ID NO: 847705

SEQ ID NO: 847708 - protein, 801 aa, Homo sapiens; identical to SEQ ID NO: 847691

SEQ ID NO: 847709 - protein, 764 aa, Homo sapiens; identical to SEQ ID NO: 847694

SEQ ID NO: 847710 - protein, 208 aa, Homo sapiens
MIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGSQLPCFHGSSTIRNLKERFHMSMTEEQLQLLVEQMVDGSMRSITTKLYDGFQYLTNGIM

SEQ ID NO: 847711 - protein, 764 aa, Homo sapiens; identical to SEQ ID NO: 847694

SEQ ID NO: 847712 - protein, 586 aa, Homo sapiens
MGDTVVEPAPLKPTSEPTSGPPGNNGGSLLSVITEGVGELSVIDPEVAQKACQEVLEKVKLLHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLQCALLLGAYSSDMHISTQRHSRGTKLRKLILSDELKPAHRKRELPSLSPAPDTGLSPSKRTHQRSKSDATASISLSSNLKRTASNPKVENEDEPVRLAPEREFIKSLMAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKRDPEDPSAVALKEPWQEKVRRIRGPPRHTPKGVRQACRGGCLGKLAQGERRAREGRMPGQQRLGTERKQNGQRKSRNQR

SEQ ID NO: 847713 - protein, 229 aa, Homo sapiens; identical to SEQ ID NO: 847703

SEQ ID NO: 847714 - protein, 178 aa, Homo sapiens
KIHKSNTRGPFAWRVFVYLFGLIWFRFVWKKGLCPPSLCRFTHLSQPGPVQPLPGGLGIWMLEVTGCPGRLVTSEAEPRPRVGPLTAKRLTRLDRAIPEMLRSLNSASSSKISRKRAVRKNVFPVRRLPARPSRNPASIPRPDLLRESCSIREGEKSLIAITACSRQLTRLLRLLWNR

SEQ ID NO: 847715 - protein, 182 aa, Homo sapiens
MAPNEGEEETKIKKKQQGESSERHTTRGRDERARGNNNTGPEPQESSSVRGGRDNTTRTTDGGGVQQHNRLEETAPNPNEKEEDHTPSAEKEEKARKKKNVAKQEKAENQQRHEHDSNTDAEAPDKQVENEAEKRTEKEKEEARAPAHRGRGQDQKAEKRKKIDTTSRRQEANTSEQESSTR

SEQ ID NO: 847716 - protein, 579 aa, Homo sapiens
MPSASCDTLLDDIEDIVSQEDSKPQDRHFVRKDVVPKVRRRNTQKYLQEEENSPPSDSTIPGIQKIWIRTWGCSHNNSDGEYMAGQLAAYGYKITENASDADLWLLNSCTVKNPAEDHFRNSIKKAQEENKKIVLAGCVPQAQPRQDYLKGLSIIGVQQIDRVVEVVEETIKGHSVRLLGQKKDNGRRLGGARLDLPKIRKNPLIEIISINTGCLNACTYCKTKHARGNLASYPIDELVDRAKQSFQEGVCEIWLTSEDTGAYGRDIGTNLPTLLWKLVEVIPEGAMLRLGMTNPPYILEHLEEMAKILNHPRVYAFLHIPVQSASDSVLMEMKREYCVADFKRVVDFLKEKVPGITIATDIICGFPGETDQDFQETVKLVEEYKFPSLFINQFYPRPGTPAAKMEQVPAQVKKQRTKDLSRVFHSYSPYDHKIGERQQVLVTEESFDSKFYVAHNQFYEQVLVPKNPAFMGKMVEVDIYESGKHFMKGQPVSDAKVYTPSISKPLAKGEVSGLTKDFRNGLGNQLSSGSHTSAASQCDSASSRMVLPMPRLHQDCALRMSVGLALLGLLFAFFVKVYN

SEQ ID NO: 847717 - protein, 496 aa, Homo sapiens
MPSASCDTLLDDIEDIVSQEDSKPQDRHFVRKDVVPKVRRRNTQKYLQEEENSPPSDSTIPGIQKIWIRTWGCSHNNSDGEYMAGQLAAYGYKITENASDADLWLLNSCTVKNPAEDHFRNSIKKAQEENKKIVLAGCVPQAQPRQDYLKGLSIIGVQQIDRVVEVVEETIKGHSVRLLGQKKDNGRRLGGARLDLPKIRKNPLIEIISINTGCLNACTYCKTKHARGNLASYPIDELVDRAKQSFQEGVCEIWLTSEDTGAYGRDIGTNLPTLLWKLVEVIPEGAMLRLGMTNPPYILEHLEEMAKILNHPRVYAFLHIPVQSASDSVLMEMKREYCVADFKRVVDFLKEKVPGITIATDIICGFPGETDQDFQETVKLVEEYKFPSLFINQFYPRPGTPAAKMEQVPAQVKKQRTKDLSRVFHSYSPYDHKDFRNGLGNQLSSGSHTSAASQCDSASSRMVLPMPRLHQDCALRMSVGLALLGLLFAFFVKVYN

SEQ ID NO: 847718 - protein, 205 aa, Homo sapiens
MTNPPYILEHLEEMAKILNHPRVYAFLHIPVQSASDSVLMEMKREYCVADFKRVVDFLKEKVPGITIATDIICGFPGETDQDFQETVKLVEEYKFPSLFINQFYPRPGTPAAKMEQVPAQVKKQRTKDLSRVFHSYSPYDHKDFRNGLGNQLSSGSHTSAASQCDSASSRMVLPMPRLHQDCALRMSVGLALLGLLFAFFVKVYN

SEQ ID NO: 847719 - protein, 579 aa, Homo sapiens; identical to SEQ ID NO: 847716

SEQ ID NO: 847720 - protein, 106 aa, Homo sapiens
MVEVDIYESGKHFMKGQPVSDAKVYTPSISKPLAKGEVSGLTKDFRNGLGNQLSSGSHTSAASQCDSASSRMVLPMPRLHQDCALRMSVGLALLGLLFAFFVKVYN

SEQ ID NO: 847721 - protein, 536 aa, Homo sapiens
MPSASCDTLLDDIEDIVSQEDSKPQDRHFVRKDVVPKVRRRNTQKYLQEEENSPPSDSTIPGIQKIWIRTWGCSHNNSDGEYMAGQLAAYGYKITENASDADLWLLNSCTVKNPAEDHFRNSIKKAQEENKKIVLAGCVPQAQPRQDYLKGLSIIGVQQIDRVVEVVEETIKGHSVRLLGQKKDNGRRLGGARLDLPKIRKNPLIEIISINTGCLNACTYCKTKHARGNLASYPIDELVDRAKQSFQEGVCEIWLTSEDTGAYGRDIGTNLPTLLWKLVEVIPEGAMLRLGMTNPPYILEHLEEMAKILNHPRVYAFLHIPVQSASDSVLMEMKREYCVADFKRVVDFLKEKVPGITIATDIICGFPGETDQDFQETVKLVEEYKFPSLFINQFYPRPGTPAAKMEQVPAQVKKQRTKDLSRVFHSYSPYDHKIGERQQVLVTEESFDSKFYVAHNQFYEQVLVPKNPAFMGKMVEVDIYESGKHFMKGQPVSDAKVYTPSISKPLAKGEVSGLTKVSKRCSPLYPASKTAAVEAQ

SEQ ID NO: 847722 - protein, 251 aa, Homo sapiens [sequence omitted]

SEQ ID NO: 847723 - protein, 175 aa, Homo sapiens
MPSASCDTLLDDIEDIVSQEDSKPQDRHFVRKDVVPKVRRRNTQKYLQEEENSPPSDSTIPGIQKIWIRTWGCSHNNSDGEYMAGQLAAYGYKITENASDADLWLLNSCTVKNPAEDHFRNSIKKAQEENKKIVLAGCVPQAQPRQDYLKGLSIIGVQQIDRVVEVVEETIKGNR

SEQ ID NO: 847724 - protein, 160 aa, Homo sapiens
MPSASCDTLLDDIEDIVSQEDSKPQDRHFVRKDVVPKVRRRNTQKYLQEEENSPPSDSTIPGIQKIWIRTWGCSHNNSDGEYMAGQLAAYGYKITENASDADLWLLNSCTVKNPAEDHFRNSIKSCPEQALFFPAVIHLRCDLLLLTVRHDCEVSPATWN

SEQ ID NO: 847725 - protein, 106 aa, Homo sapiens; identical to SEQ ID NO: 847720

SEQ ID NO: 847726 - protein, 257 aa, Homo sapiens
MPSASCDTLLDDIEDIVSQEDSKPQDRHFVRKDVVPKVRRRNTQKYLQEEENSPPSDSTIPGIQKIWIRTWGCSHNNSDGEYMAGQLAAYGYKITENASDADLWLLNSCTVKNPAEDHFRNSIKKAQEENKKIVLAGCVPQAQPRQDYLKGLSIIGVQQIDRVVEVVEETIKGHSVRLLGQKKDNGRRLGGARLDLPKIRKNPLIEIISINTGCLNACTYCKTKHARGNLASYPIDELVDRAKQSFQGSLHLLLYQK

SEQ ID NO: 847727 - protein, 175 aa, Homo sapiens; identical to SEQ ID NO: 847723

SEQ ID NO: 847728 - protein, 651 aa, Homo sapiens
MADSAELKQMVMSLRVSELQVLLGYAGRNKHGRKHELLTKALHLLKAGCSPAVQMKIKELYRRRFPQKIMTPADLSIPNVHSSPMPATLSPSTIPQLTYDGHPASSPLLPVSLLGPKHELELPHLTSALHPVHPDIKLQKLPFYDLLDELIKPTSLASDNSQRFRETCFAFALTPQQVQQISSSMDISGTKCDFTVQVQLRFCLSETSCPQEDHFPPNLCVKVNTKPCSLPGYLPPTKNGVEPKRPSRPINITSLVRLSTTVPNTIVVSWTAEIGRNYSMAVYLVKQLSSTVLLQRLRAKGIRNPDHSRALIKEKLTADPDSEIATTSLRVSLLCPLGKMRLTIPCRALTCSHLQCFDATLYIQMNEKKPTWVCPVCDKKAPYEHLIIDGLFMEILKYCTDCDEIQFKEDGTWAPMRSKKEVQEVSASYNGVDGCLSSTLEHQVASHHQSSNKNKKVEVIDLTIDSSSDEEEEEPSAKRTCPSLSPTSPLNNKGILSLPHQASPVSRTPSLPAVDTSYINTSLIQDYRHPFHMTPMPYDLQGLDFFPFLSGDNQHYNTSLLAAAAAAVSDDQDLLHSSRFFPYTSSQMFLDQLSAGGSTSLPTTNGSSSGSNSSLVSSNSLRESHSHTVTNRSSTDTASIFGIIPDIISLD

SEQ ID NO: 847729 - protein, 155 aa, Homo sapiens
TLRLGSEAWVLHPSLPAVDTSYINTSLIQDYRHPFHMTPMPYDLQGLDFFPFLSGDNQHYNTSLLAAAAAAVSDDQDLLHSSRFFPYTSSQMFLDQLSAGGSTSLPTTNGSSSGSNSSLVSSNSLRESHSHTVTNRSSTDTASIFGIIPDIISLD

SEQ ID NO: 847730 - protein, 175 aa, Homo sapiens
MADSAELKQMVMSLRVSELQVLLGYAGRNKHGRKHELLTKALHLLKAGCSPAVQMKIKELYRRRFPQKIMTPADLSIPNVHSSPMPATLSPSTIPQLTYDGHPASSPLLPVSLLGPKHELELPHLTSALHPVHPDIKLQKLPFYDLLDELIKPTSLEVRLLYDSIWLLLQDEFSF

SEQ ID NO: 847731 - protein, 651 aa, Homo sapiens; identical to SEQ ID NO: 847728

SEQ ID NO: 847732 - protein, 642 aa, Homo sapiens
MVMSLRVSELQVLLGYAGRNKHGRKHELLTKALHLLKAGCSPAVQMKIKELYRRRFPQKIMTPADLSIPNVHSSPMPATLSPSTIPQLTYDGHPASSPLLPVSLLGPKHELELPHLTSALHPVHPDIKLQKLPFYDLLDELIKPTSLASDNSQRFRETCFAFALTPQQVQQISSSMDISGTKCDFTVQVQLRFCLSETSCPQEDHFPPNLCVKVNTKPCSLPGYLPPTKNGVEPKRPSRPINITSLVRLSTTVPNTIVVSWTAEIGRNYSMAVYLVKQLSSTVLLQRLRAKGIRNPDHSRALIKEKLTADPDSEIATTSLRVSLLCPLGKMRLTIPCRALTCSHLQCFDATLYIQMNEKKPTWVCPVCDKKAPYEHLIIDGLFMEILKYCTDCDEIQFKEDGTWAPMRSKKEVQEVSASYNGVDGCLSSTLEHQVASHHQSSNKNKKVEVIDLTIDSSSDEEEEEPSAKRTCPSLSPTSPLNNKGILSLPHQASPVSRTPSLPAVDTSYINTSLIQDYRHPFHMTPMPYDLQGLDFFPFLSGDNQHYNTSLLAAAAAAVSDDQDLLHSSRFFPYTSSQMFLDQLSAGGSTSLPTTNGSSSGSNSSLVSSNSLRESHSHTVTNRSSTDTASIFGIIPDIISLD

SEQ ID NO: 847733 - protein, 611 aa, Homo sapiens
MADSAELKQMVMSLRVSELQVLLGYAGRNKHGRKHELLTKALHLLKAGCSPAVQMKIKELYRRRFPQKIMTPADLSIPNVHSSPMPATLSPSTIPQLTYDGHPASSPLLPVSLLGPKHELELPHLTSALHPVHPDIKLQKLPFYDLLDELIKPTSLASDNSQRFRETCFAFALTPQQVQQISSSMDISGTKCDFTVQVQLREPKRPSRPINITSLVRLSTTVPNTIVVSWTAEIGRNYSMAVYLVKQLSSTVLLQRLRAKGIRNPDHSRALIKEKLTADPDSEIATTSLRVSLLCPLGKMRLTIPCRALTCSHLQCFDATLYIQMNEKKPTWVCPVCDKKAPYEHLIIDGLFMEILKYCTDCDEIQFKEDGTWAPMRSKKEVQEVSASYNGVDGCLSSTLEHQVASHHQSSNKNKKVEVIDLTIDSSSDEEEEEPSAKRTCPSLSPTSPLNNKGILSLPHQASPVSRTPSLPAVDTSYINTSLIQDYRHPFHMTPMPYDLQGLDFFPFLSGDNQHYNTSLLAAAAAAVSDDQDLLHSSRFFPYTSSQMFLDQLSAGGSTSLPTTNGSSSGSNSSLVSSNSLRESHSHTVTNRSSTDTASIFGIIPDIISLD

SEQ ID NO: 847734 - protein, 508 aa, Homo sapiens
MADSAELKQMVMSLRVSELQVLLGYAGRNKHGRKHELLTKALHLLKAGCSPAVQMKIKELYRRRFPQKIMTPADLSIPNVHSSPMPATLSPSTIPQLTYDGHPASSPLLPVSLLGPKHELELPHLTSALHPVHPDIKLQKLPFYDLLDELIKPTSLASDNSQRFRETCFAFALTPQQVQQISSSMDISGTKCDFTVQVQLRFCLSETSCPQEDHFPPNLCVKVNTKPCSLPGYLPPTKNGVEPKRPSRPINITSLVRLSTTVPNTIVVSWTAEIGRNYSMAVYLVKQLSSTVLLQRLRAKGIRNPDHSRALIKEKLTADPDSEIATTSLRVSLLCPLGKMRLTIPCRALTCSHLQCFDATLYIQMNEKKPTWVCPVCDKKAPYEHLIIDGLFMEILKYCTDCDEIQFKEDGTWAPMRSKKEVQEVSASYNGVDGCLSSTLEHQVASHHQSSNKNKKVEVIDLTIDSSSDEEEEEPSAKRTAAGVCPQSRRLKYNRSDVIARYELVCLY

SEQ ID NO: 847735 - protein, 325 aa, Homo sapiens
MADSAELKQMVMSLRVSELQVLLGYAGRNKHGRKHELLTKALHLLKAGCSPAVQMKIKELYRRRFPQKIMTPADLSIPNVHSSPMPATLSPSTIPQLTYDGHPASSPLLPVSLLGPKHELELPHLTSALHPVHPDIKLQKLPFYDLLDELIKPTSLASDNSQRFRETCFAFALTPQQVQQISSSMDISGTKCDFTVQVQLRFCLSETSCPQEDHFPPNLCVKVNTKPCSLPGYLPPTKNGVEPKRPSRPINITSLVRLSTTVPNTIVVSWTAEIGRNYSMAVYLVKQLSSTVLLQRLRAKGIRNPDHSRALSTYDKLISLIQLFC

SEQ ID NO: 847736 - protein, 160 aa, Homo sapiens
MADSAELKQMVMSLRVSELQVLLGYAGRNKHGRKHELLTKALHLLKAGCSPAVQMKIKELYRRRFPQKIMTPADLSIPNVHSSPMPATLSPSTIPQLTYDGHPASSPLLPVSLLGPKHELELPHLTSALHPVHPDIKLQKLPFYDLLDELIKPTSLAEII

SEQ ID NO: 847737 - protein, 651 aa, Homo sapiens; identical to SEQ ID NO: 847728

SEQ ID NO: 847738 - protein, 651 aa, Homo sapiens; identical to SEQ ID NO: 847728

SEQ ID NO: 847739 - protein, 651 aa, Homo sapiens; identical to SEQ ID NO: 847728

SEQ ID NO: 847740 - protein, 633 aa, Homo sapiens
MADSAELKQMVMSLRVSELQVLLGYAGRNKHGRKHELLTKALHLLKAGCSPAVQMKIKELYRRRFPQKIMTPADLSIPNVHSSPMPATLSPSTIPQLTYDGHPASSPLLPVSLLGPKHELELPHLTSALHPVHPDIKLQKLPFYDLLDELIKPTSLASDNSQRFRETCFAFALTPQQVQQISSSMDISGTKCDFTVQVQLRFCLSETSCPQEDHFPPNLCVKVNTKPCSLPGYLPPTKNGVEPKRPSRPINITSLVRLSTTVPNTIVVSWTAEIGRNYSMAVYLVKQLSSTVLLQRLRAKGIRNPDHSRALIKEKLTADPDSEIATTSLRVSLLCPLGKMRLTIPCRALTCSHLQCFDATLYIQMNEKKPTWVCPVCDKKAPYEHLIIDGLFMEILKYCTDCDEIQFKEDGTWAPMRSKKEVQEVSASYNGVDGCLSSTLEHQVASHHQSSNKEEEPSAKRTCPSLSPTSPLNNKGILSLPHQASPVSRTPSLPAVDTSYINTSLIQDYRHPFHMTPMPYDLQGLDFFPFLSGDNQHYNTSLLAAAAAAVSDDQDLLHSSRFFPYTSSQMFLDQLSAGGSTSLPTTNGSSSGSNSSLVSSNSLRESHSHTVTNRSSTDTASIFGIIPDIISLD

SEQ ID NO: 847741 - protein, 642 aa, Homo sapiens; identical to SEQ ID NO: 847732

SEQ ID NO: 847742 - protein, 637 aa, Homo sapiens
MADSAELKQMVMSLRVSELQVLLGYAGRNKHGRKHELLTKALHLLKAGCSPAVQMKIKELYRRRFPQKIMTPADLSIPNVHSSPMPATLSPSTIPQLTYDGHPASSPLLPVSLLGPKHELELPHLTSALHPVHPDIKLQKLPFYDLLDELIKPTSLASDNSQRFRETCFAFALTPQQVQQISSSMDISGTKCDFTVQVQLRFCLSETSCPQEDHFPPNLCVKVNTKPCSLPGYLPPTKNGVEPKRPSRPINITSLVRLSTTVPNTIVVSWTAEIGRNYSMAVYLVKQLSSTVLLQRLRAKGIRNPDHSRALIKEKLTADPDSEIATTSLRVSLLCPLGKMRLTIPCRALTCSHLQCFDATLYIQMNEKKPTWVCPVCDKKAPYEHLIIDGLFMEILKYCTDCDEIQFKEDGTWAPMRSKKEVQEVSASYNGVDGCLSSTLEHQVASHHQSSNKNKKVEVIDLTIDSSSDEEEEEPSAKRTCPSLSPTSPLNNKGILSLPHQASPVSRTPSLPAVDTSYINTSLIQDYRHPFHMTPMPYDLQGLDFFPFLSGDNQHYNTSLLAAAAAAVSDDQDLLHSSRFFPYTSRCSVSSRKKGGGGGGGPPQKGGFKPLFPSFPKPPQPMEAVVAVTAAWFLPTA

SEQ ID NO: 847743 - protein, 319 aa, Homo sapiens
LLLCVRSGVCFAHIAARRVRAGVVVLLSCVGVVAARRRVSCWVAVVCLWAADIGVRVGGAVLGEAERFRLVRVAPSARRCPLWGGLFRIGAWCGVVLVGFGVGFVAIIVACAFGTMCAVVLVRGVAELWYATGPNFVWVAAVRQVRVAVGPIRRGARGSHGAAMCSDRWRSLRSGPLGCGGGAVPRCVSVVCESCVPVEGAGGPVAVREGMENTARSGRQGNGVSVGEERKEGAAAGSPRPRACLGPRVLRGQGQGQESCLCRGRLDLGHQRSGHGCRAHNRDRYTRSLAPGWARHRPASPTAAGTVGGTPPTVNPEVP

SEQ ID NO: 847744 - protein, 204 aa, Homo sapiens
MFVLVEMVDTVRIPPWQFERKLNDSIAEELNKKLANKVVYNVGLCICLFDITKLEDAYVFPGDGASHTKVHFRCVVFHPFLDEILIGKIKGCSPEGVHVSLGFFDDILIPPESLQQPAKFDEAEQVWVWEYETEEGAHDLYMDTGEEIRFRVVDESFVDTSPTGPSSADATTSSEELPKKEAPYTLVGSISEPGLGLLSWWTSN

SEQ ID NO: 847745 - protein, 204 aa, Homo sapiens; identical to SEQ ID NO: 847744

SEQ ID NO: 847746 - protein, 239 aa, Homo sapiens
GRVAQARAAVRGAAVRGAWCVVRDTSGGEPPAQAGMFVLVEMVDTVRIPPWQFERKLNDSIAEELNKKLANKVVYNVGLCICLFDITKLEDAYVFPGDGASHTKVHFRCVVFHPFLDEILIGKIKGCSPEGVHVSLGFFDDILIPPESLQQPAKFDEAEQVWVWEYETEEGAHDLYMDTGEEIRFRVVDESFVDTSPTGPSSADATTSSEELPKKEAPYTLVGSISEPGLGLLSWWTSN

SEQ ID NO: 847747 - protein, 222 aa, Homo sapiens
MFVLVEMVDTVRIPPWQFERKLNDSIAEELNKKLANKVVYNVGLCICLFDITKLEDAYVFPGDGASHTKVHFRCVVFHPFLDEILIGKIKGCSPEGVHGTVALTPQTRLGNTVGAGVSLGFFDDILIPPESLQQPAKFDEAEQVWVWEYETEEGAHDLYMDTGEEIRFRVVDESFVDTSPTGPSSADATTSSEELPKKEAPYTLVGSISEPGLGLLSWWTSN

SEQ ID NO: 847748 - protein, 126 aa, Homo sapiens
MRPKRGPEGTEARGCLQWQRRQKPPIGAWQRQVCVEGGWVRQGRPPGPTQDASVKLKAPPSWEHPLPHPATRGCQSPFTRLGQDLGSALVLFVSQSRKSPITSDPLCLLTVRPRVAPSLSFWPLTS

SEQ ID NO: 847749 - protein, 204 aa, Homo sapiens; identical to SEQ ID NO: 847744

SEQ ID NO: 847750 - protein, 152 aa, Homo sapiens
MFVLVEMVDTVRIPPWQFERKLNDSIAEELNKKLANKVVYNVGLCICLFDITKLEDAYVFPGDGASHTKVHFRCVVFHPFLDEILIGKIKGCSPEGVHVSLGFFDDILIPPESLQQPAKFDEAEQCGFGVKTGRSQTLLTREEPSGWPTCES

SEQ ID NO: 847751 - protein, 204 aa, Homo sapiens; identical to SEQ ID NO: 847744

SEQ ID NO: 847752 - protein, 145 aa, Homo sapiens
MFVLVEMVDTVRIPPWQFERKLNDSIAEELNKKLANKFLSGFFRCTFFIPPQSQLQQPAKFDEAEQVWVWEYETEEGAHDLYMDTGEEIRFRVVDESFVDTSPTGPSSADATTSSEELPKKEAPYTLVGSISEPGLGLLSWWTSN

SEQ ID NO: 847753 - protein, 204 aa, Homo sapiens; identical to SEQ ID NO: 847744

SEQ ID NO: 847754 - protein, 479 aa, Homo sapiens
MAALEKMTFPKKMTFPEKPSHKKYRAALKKEKRKKRRQELARLRDSGLSQEEEEDTFIEEQQLEEEKLLERERERLHEEWLLREQKAQEEFRIKKEKEEAAKKWLEEQERKLKEQWKEQQRKEREEEEQKQQEKKEKEEAVQKMLDQAENDLENSTTWQNPEPPVDFRVMEKDRANCPFYSKTGACRFGDRCSRKHNFPTSSPTLLIKSMFTTFGMEQCRRDDYDPDASLEYSEEETYQQFLDFYEDVLPEFKNVGKVIQFKVSCNLEPHLRGNVYVQYQSEEECQAALSLFNGRWYAGRQLQCEFCPVTRWKMAICGLFEIQQCPRGKHCNFLHVFRNPNNEFWEANRDIYLSSDQTGSSFGKNSERREKMGHHDHYYSRQRGRRNPSPDHTYKRNGESERKKSSHRGKKSHKRTSKSRERHNSPSRGRNRHRSWDQGRRSQSRRSHRSRSQSSSRCRSRGRRKSGNRDRTVQSPQSK

SEQ ID NO: 847755 - protein, 504 aa, Homo sapiens
MYVQQLDLTYFLRLRMSEGSGGAGKMAALEKMTFPKKMTFPEKPSHKKYRAALKKEKRKKRRQELARLRDSGLSQEEEEDTFIEEQQLEEEKLLERERERLHEEWLLREQKAQEEFRIKKEKEEAAKKWLEEQERKLKEQWKEQQRKEREEEEQKQQEKKEKEEAVQKMLDQAENDLENSTTWQNPEPPVDFRVMEKDRANCPFYSKTGACRFGDRCSRKHNFPTSSPTLLIKSMFTTFGMEQCRRDDYDPDASLEYSEEETYQQFLDFYEDVLPEFKNVGKVIQFKVSCNLEPHLRGNVYVQYQSEEECQAALSLFNGRWYAGRQLQCEFCPVTRWKMAICGLFEIQQCPRGKHCNFLHVFRNPNNEFWEANRDIYLSSDQTGSSFGKNSERREKMGHHDHYYSRQRGRRNPSPDHTYKRNGESERKKSSHRGKKSHKRTSKSRERHNSPSRGRNRHRSWDQGRRSQSRRSHRSRSQSSSRCRSRGRRKSGNRDRTVQSPQSK

SEQ ID NO: 847756 - protein, 616 aa, Homo sapiens
RAGFLPGFCRVSPCGSWVVETLVKMACAAARSPADQDRFICIYPAYLNNKKTIAEGRRIPISKAVENPTATEIQDVCSAVGLNVFLEKNKMYSREWNRDVQYRGRVRVQLKQEDGSLCLVQFLITLRMSEGSGGAGKMAALEKMTFPKKMTFPEKPSHKKYRAALKKEKRKKRRQELARLRDSGLSQEEEEDTFIEEQQLEEEKLLERERERLHEEWLLREQKAQEEFRIKKEKEEAAKKWLEEQERKLKEQWKEQQRKEREEEEQKQQEKKEKEEAVQKMLDQAENDLENSTTWQNPEPPVDFRVMEKDRANCPFYSKTGACRFGDRCSRKHNFPTSSPTLLIKSMFTTFGMEQCRRDDYDPDASLEYSEEETYQQFLDFYEDVLPEFKNVGKVIQFKVSCNLEPHLRGNVYVQYQSEEECQAALSLFNGRWYAGRQLQCEFCPVTRWKMAICGLFEIQQCPRGKHCNFLHVFRNPNNEFWEANRDIYLSSDQTGSSFGKNSERREKMGHHDHYYSRQRGRRNPSPDHTYKRNGESERKKSSHRGKKSHKRTSKSRERHNSPSRGRNRHRSWDQGRRSQSRRSHRSRSQSSSRCRSRGRRKSGNRDRTVQSPQSK

SEQ ID NO: 847757 - protein, 1009 aa, Homo sapiens
GAVHAGTAVGGACARIMAAEWASRFWLWATLLIPAAAVYEDQVGKFDWRQQYVGKVKFASLEFSPGSKKLVVATEKNVIAALNSRTGEILWRHVDKGTAEGAVDAMLLHGQDVITVSNGGRIMRSWETNIGGLNWEITLDSGSFQALGLVGLQESVRYIAVLKKTTLALHHLSSGHLKWVEHLPESDSIHYQMVYSYGSGVVWALGVVPFSHVNIVKFNVEDGEIVQQVRVSTPWLQHLSGACGVVDEAVLVCPDPSSRSLQTLALETEWELRQIPLQSLDLEFGSGFQPRVLPTQPNPVDASRAQFFLHLSPSHYALLQYHYGTLSLLKNFPQTALVSFATTGEKTVAAVMACRNEVQKSSSSEDGSMGSFSEKSSSKDSLACFNQTYTINLYLVETGRRLLDTTITFSLEQSGTRPERLYIQVFLKKDDSVGYRALVQTEDHLLLFLQQLAGKVVLWSREESLAEVVCLEMVDLPLTGAQAELEGEFGKKADGLLGMFLKRLSSQLILLQAWTSHLWKMFYDARKPRSQIKNEINIDTLARDEFNLQKMMVMVTASGKLFGIESSSGTILWKQYLPNVKPDSSFKLMVQRTTAHFPHPPQCTLLVKDKESGMSSLYVFNPIFGKWSQVAPPVLKRPILQSLLLPVMDQDYAKVLLLIDDEYKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSREENLIPYSPDVQIHAERFINYNQTVSRMRGIYTAPSGLESTCLVVAYGLDIYQTRVYPSKQFDVLKDDYDYVLISSVLFGLVFATMITKRLAQVKLLNRAWR

SEQ ID NO: 847758 - protein, 1009 aa, Homo sapiens; identical to SEQ ID NO: 847757

SEQ ID NO: 847759 - protein, 1009 aa, Homo sapiens; identical to SEQ ID NO: 847757

SEQ ID NO: 847760 - protein, 658 aa, Homo sapiens
MACRNEVQKSSSSEDGSMGSFSEKSSSKDSLACFNQTYTINLYLVETGRRLLDTTITFSLEQSGTRPERLYIQVFLKKDDSVGYRALVQTEDHLLLFLQQLAGKVVLWSREESLAEVVCLEMVDLPLTGAQAELEGEFGKKADGLLGMFLKRLSSQLILLQAWTSHLWKMFYDARKPRSQIKNEINIDTLARDEFNLQKMMVMVTASGKLFGIESSSGTILWKQYLPNVKPDSSFKLMVQRTTAHFPHPPQCTLLVKDKESGMSSLYVFNPIFGKWSQVAPPVLKRPILQSLLLPVMDQDYAKVLLLIDDEYKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSREENLIPYSPDVQIHAERFINYNQTVSRMRGIYTAPSGLESTCLVVAYGLDIYQTRVYPSKQFDVLKDDYDYVLISSVLFGLVFATMITKRLAQVKLLNRAWR

SEQ ID NO: 847761 - protein, 915 aa, Homo sapiens
GAVHAGTAVGGACARIMAAEWASRFWLWATLLIPAAAVYEDQVGKFDWRQQYVGKVKFASLEFSPGSKKLVVATEKNVIAALNSRTGEILWRHVDKGTAEGAVDAMLLHGQDVITVSNGGRIMRSWETNIGGLNWEITLDSGSFQALGLVGLQESVRYIAVLKKTTLALHHLSSGHLKWVEHLPESDSIHYQMVYSYGSGVVWALGVVPFSHVNIVKFNVEDGEIVQQVRVSTPWLQHLSGACGVVDEAVLVCPDPSSRSLQTLALETEWELRQIPLQSLDLEFGSGFQPRVLPTQPNPVDASRAQFFLHLSPSHYALLQYHYGTLSLLKNFPQTALVSFATTGEKTVAAVMACRNEVQKSSSSEDGSMGSFSEKSSSKDSLACFNQTYTINLYLVETGRRLLDTTITFSLEQSGTRPERLYIQVFLKKDDSVGYRALVQTEDHLLLFLQQLAGKVVLWSREESLAEVVCLEMVDLPLTGAQAELEGEFGKKADGLLGMFLKRLSSQLILLQAWTSHLWKMFYDARKPRSQIKNEINIDTLARDEFNLQKMMVMVTASGKLFGIESSSGTILWKQYLPNVKPDSSFKLMVQRTTAHFPHPPQCTLLVKDKESGMSSLYVFNPIFGKWSQVAPPVLKRPILQSLLLPVMDQDYAKVLLLIDDEYKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLSFAGSPPPRDPNRTKQRGELNPVFSRCTDTRRAIHQL

SEQ ID NO: 847762 - protein, 918 aa, Homo sapiens
GAVHAGTAVGGACARIMAAEWASRFWLWATLLIPAAAVYEDQVGKFDWRQQYVGKVKFASLEFSPGSKKLVVATEKNVIAALNSRTGEILWRHVDKGTAEGAVDAMLLHGQDVITVSNGGRIMRSWETNIGGLNWEITLDSGSFQALGLVGLQESVRYIAVLKKTTLALHHLSSGHLKWVEHLPESDSIHYQMVYSYGSGVVWALGVVPFSHVNIVKFNVEDGEIVQQVRVSTPWLQHLSGACGVVDEAVLVCPDPSSRSLQTLALETEWELRQIPLQSLDLEFGSGFQPRVLPTQPNPVDASRAQFFLHLSPSHYALLQYHYGTLSLLKNFPQTALVSFATTGEKTVAAVMACRNEVQKSSSSEDGSMGSFSEKSSSKDSLACFNQTYTINLYLVETGRRLLDTTITFSLEQSGTRPERLYIQVFLKKDDSVGYRALVQTEDHLLLFLQQLAGKVVLWSREESLAEVVCLEMVDLPLTGAQAELEGEFGKKADGLLGMFLKRLSSQLILLQAWTSHLWKMFYDARKPRSQIKNEINIDTLARDEFNLQKMMVMVTASGKLFGIESSSGTILWKQYLPNVKPDSSFKLMVQRTTAHFPHPPQCTLLVKDKESGMSSLYVFNPIFGKWSQVAPPVLKRPILQSLLLPVMDQDYAKVLLLIDDEYKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSRCTDTRRAIHQL

SEQ ID NO: 847763 - protein, 318 aa, Homo sapiens
CPHLVTFLSGDVLDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSREENLIPYSPDVQIHAERFINYNQTVSRMRGIYTAPSGLESTCLVVAYGLDIYQTRVYPSKQFDVLKDDYDYVLISSVLFGLVFATMITKRLAQVKLLNRAWR

SEQ ID NO: 847764 - protein, 918 aa, Homo sapiens; identical to SEQ ID NO: 847762

SEQ ID NO: 847765 - protein, 109 aa, Homo sapiens [sequence omitted]

SEQ ID NO: 847766 - protein, 1009 aa, Homo sapiens; identical to SEQ ID NO: 847757

SEQ ID NO: 847767 - protein, 658 aa, Homo sapiens; identical to SEQ ID NO: 847760

SEQ ID NO: 847768 - protein, 658 aa, Homo sapiens; identical to SEQ ID NO: 847760

SEQ ID NO: 847769 - protein, 495 aa, Homo sapiens
MSSLYVFNPIFGKWSQVAPPVLKRPILQSLLLPVMDQDYAKVLLLIDDEYKVLSSEGMENMLAESGLGPGGQTQRPGDGVLSAPSTCLGSKAIPKRNDGCVCICENSEFLTELNVNPKLSSNQLICSFILKALFDGKFPNSFLGLSGFFKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSREENLIPYSPDVQIHAERFINYNQTVSRMRGIYTAPSGLESTCLVVAYGLDIYQTRVYPSKQFDVLKDDYDYVLISSVLFGLVFATMITKRLAQVKLLNRAWR

SEQ ID NO: 847770 - protein, 106 aa, Homo sapiens
NACKGPGPKFPGWANYYYKIRGPGGTKQVSRMRGIYTAPSGLESTCLVVAYGLDIYQTRVYPSKQFDVLKDDYDYVLISSVLFGLVFATMITKRLAQVKLLNRAWR

SEQ ID NO: 847771 - protein, 408 aa, Homo sapiens
GAVHAGTAVGGACARIMAAEWASRFWLWATLLIPAAAVYEDQVGKFDWRQQYVGKVKFASLEFSPGSKKLVVATEKNVIAALNSRTGEILWRHVDKGTAEGAVDAMLLHGQDVITVSNGGRIMRSWETNIGGLNWEITLDSGSFQALGLVGLQESVRYIAVLKKTTLALHHLSSGHLKWVEHLPESDSIHYQMVYSYGSGVVWALGVVPFSHVNIVKFNVEDGEIVQQVRVSTPWLQHLSGACGVVDEAVLVCPDPSSRSLQTLALETEWELRQIPLQSSRSLGIWKVDSRWPGILAVAPAPEPQMARRCRGRQLSFSWHLGPPKGPATGSWLGQLAQLSANKRACHDSVARRDNTTGYITPPAKDLVATRKGYEAPMLRPKRQTWWGANATTGNRGLGDLGPEGAQF

SEQ ID NO: 847772 - protein, 1176 aa, Homo sapiens
RGRGGCQGISGRGREEAAAAAAGRAGSRGKEKERKEEGGESSEEEAGPAGHLTSRRRRRRRRRRAAGEAAPPPARRSSQRSRPRTRWSRAAAKATGAGAVGRSAAAAAAAEEEEAGVGAEATAMAFLKLRDQPSLVQAIFNGDPDEVRALIFKKEDVNFQDNEKRTPLHAAAYLGDAEIIELLILSGARVNAKDSKWLTPLHRAVASCSEEAVQVLLKHSADVNARDKNWQTPLHIAAANKAVKCAEALVPLLSNVNVSDRAGRTALHHAAFSGHGEMVKLLLSRGANINAFDKKDRRAIHWAAYMGHIEVVKLLVSHGAEVTCKDKKSYTPLHAAASSGMISVVKYLLDLGVDMNEPNAYGNTPLHVACYNGQDVVVNELIDCGAIVNQKNEKGFTPLHFAAASTHGALCLELLVGNGADVNMKSKDGKTPLHMTALHGRFSRSQTIIQSGAVIDCEDKNGNTPLHIAARYGHELLINTLITSGADTAKRGIHGMFPLHLAALSGFSDCCRKLLSSGFDIDTPDDFGRTCLHAAAAGGNLECLNLLLNTGADFNKKDKFGRSPLHYAAANCNYQCLFALVGSGASVNDLDERGCTPLHYAATSDTDGKCLEYLLRNDANPGIRDKQGYNAVHYSAAYGHRLCLQLIASETPLDVLMETSGTDMLSDSDNRATISPLHLAAYHGHHQALEVLVQSLLDLDVRNSSGRTPLDLAAFKGHVECVDVLINQGASILVKDYILKRTPIHAAATNGHSECLRLLIGNAEPQNAVDIQDGNGQTPLMLSVLNGHTDCVYSLLNKGANVDAKDKWGRTALHRGAVTGHEECVDALLQHGAKCLLRDSRGRTPIHLSAACGHIGVLGALLQSAASMDANPATADNHGYTALHWACYNGHETCVELLLEQEVFQKTEGNAFSPLHCAVINDNEGAAEMLIDTLGASIVNATDSKGRTPLHAAAFTDHVECLQLLLSHNAQVNSVDSTGKTPLMMAAENGQTNTVEMLVSSASAELTLQDNSKNTALHLACSKGHETSALLILEKITDRNLINATNAALQTPLHVAARNGLTMVVQELLGKGASVLAVDENGYTPALACAPNKDVADCLALILATMMPVSSSSPLSSLTFNAINRYTNTSKTVSFEALPIMRNEPSSYCSFNNIGGEQEYLYTDVDELNDSDSETY

SEQ ID NO: 847773 - protein, 687 aa, Homo sapiens
MKGRYVMMSKDGKTPLHMTALHGRFSRSQTIIQSGAVIDCEDKNGNTPLHIAARYGHELLINTLITSGADTAKRGIHGMFPLHLAALSGFSDCCRKLLSSGFDIDTPDDFGRTCLHAAAAGGNLECLNLLLNTGADFNKKDKFGRSPLHYAAANCNYQCLFALVGSGASVNDLDERGCTPLHYAATSDTDGKCLEYLLRNDANPGIRDKQGYNAVHYSAAYGHRLCLQLIASETPLDVLMETSGTDMLSDSDNRATISPLHLAAYHGHHQALEVLVQSLLDLDVRNSSGRTPLDLAAFKGHVECVDVLINQGASILVKDYILKRTPIHAAATNGHSECLRLLIGNAEPQNAVDIQDGNGQTPLMLSVLNGHTDCVYSLLNKGANVDAKDKWGRTALHRGAVTGHEECVDALLQHGAKCLLRDSRGRTPIHLSAACGHIGVLGALLQSAASMDANPATADNHGYTALHWACYNGHETCVELLLEQEVFQKTEGNAFSPLHCAVINDNEGAAEMLIDTLGASIVNATDSKGRTPLHAAAFTDHVECLQLLLSHNAQVNSVDSTGKTPLMMAAENGQTNTVEMLVSSASAELTLQDNSKNTALHLACSKGHETSALLILEKITDRNLINATNAALQTPLHVAARNGLTMVVQELLGKGASVLAVDENGKRHFDIHVEIQPKRKDPTVSQC

SEQ ID NO: 847774 - protein, 438 aa, Homo sapiens
MHFNRETISPLHLAAYHGHHQALEVLVQSLLDLDVRNSSGRTPLDLAAFKGHVECVDVLINQGASILVKDYILKRTPIHAAATNGHSECLRLLIGNAEPQNAVDIQDGNGQTPLMLSVLNGHTDCVYSLLNKGANVDAKDKWGRTALHRGAVTGHEECVDALLQHGAKCLLRDSRGRTPIHLSAACGHIGVLGALLQSAASMDANPATADNHGYTALHWACYNGHETCVELLLEQEVFQKTEGNAFSPLHCAVINDNEGAAEMLIDTLGASIVNATDSKGRTPLHAAAFTDHVECLQLLLSHNAQVNSVDSTGKTPLMMAAENGQTNTVEMLVSSASAELTLQDNSKNTALHLACSKGHETSALLILEKITDRNLINATNAALQTPLHVAARNGLTMVVQELLGKGASVLAVDENGKRHFDIHVEIQPKRKDPTVSQC

SEQ ID NO: 847775 - protein, 365 aa, Homo sapiens
SPAEENVFMLLILTLVLLEVDRLVQLGVRSSVICLGFLTPLMLSVLNGHTDCVYSLLNKGANVDAKDKWGRTALHRGAVTGHEECVDALLQHGAKCLLRDSRGRTPIHLSAACGHIGVLGALLQSAASMDANPATADNHGYTALHWACYNGHETCVELLLEQEVFQKTEGNAFSPLHCAVINDNEGAAEMLIDTLGASIVNATDSKGRTPLHAAAFTDHVECLQLLLSHNAQVNSVDSTGKTPLMMAAENGQTNTVEMLVSSASAELTLQDNSKNTALHLACSKGHETSALLILEKITDRNLINATNAALQTPLHVAARNGLTMVVQELLGKGASVLAVDENGKRHFDIHVEIQPKRKDPTVSQC

SEQ ID NO: 847776 - protein, 1013 aa, Homo sapiens
MSRVCIVVLEEVEDESPAFISKLPQENKSLHSPPSGNVLVRPSLVQAIFNGDPDEVRALIFKKEDVNFQDNEKRTPLHAAAYLGDAEIIELLILSGARVNAKDSKWLTPLHRAVASCSEEAVQVLLKHSADVNARDKNWQTPLHIAAANKAVKCAEALVPLLSNVNVSDRAGRTALHHAAFSGHGEMVKLLLSRGANINAFDKKDRRAIHWAAYMGHIEVVKLLVSHGAEVTCKDKKSYTPLHAAASSGMISVVKYLLDLGVDMNEPNAYGNTPLHVACYNGQDVVVNELIDCGAIVNQKNEKGFTPLHFAAASTHGALCLELLVGNGADVNMKSKDGKTPLHMTALHGRFSRSQTIIQSGAVIDCEDKNGNTPLHIAARYGHELLINTLITSGADTAKRGIHGMFPLHLAALSGFSDCCRKLLSSGFDIDTPDDFGRTCLHAAAAGGNLECLNLLLNTGADFNKKDKFGRSPLHYAAANCNYQCLFALVGSGASVNDLDERGCTPLHYAATSDTDGKCLEYLLRNDANPGIRDKQGYNAVHYSAAYGHRLCLQLIASETPLDVLMETSGTDMLSDSDNRATISPLHLAAYHGHHQALEVLVQSLLDLDVRNSSGRTPLDLAAFKGHVECVDVLINQGASILVKDYILKRTPIHAAATNGHSECLRLLIGNAEPQNAVDIQDGNGQTPLMLSVLNGHTDCVYSLLNKGANVDAKDKWGRTALHRGAVTGHEECVDALLQHGAKCLLRDSRGRTPIHLSAACGHIGVLGALLQSAASMDANPATADNHGYTALHWACYNGHETCVELLLEQEVFQKTEGNAFSPLHCAVINDNEGAAEMLIDTLGASIVNATDSKGRTPLHAAAFTDHVECLQLLLSHNAQVNSVDSTGKTPLMMAAENGQTNTVEMLVSSASAELTLQDNSKNTALHLACSKGHETSALLILEKITDRNLINATNAALQTPLHVAARNGLTMVVQELLGKGASVLAVDENGKRHFDIHVEIQPKRKDPTVSQC

SEQ ID NO: 847777 - protein, 489 aa, Homo sapiens
QGRRAQEARAQCAGYQATPGQGVSAVGVMVSRVQLPPEIQLAQRLAGNEQVTRDRAVRKLRKYIVARTQRAAGGFTHDELLKVWKGLFYCMWMQDKPLLQEELGRTISQLVHAFQTTEAQHLFLQAFWQTMNREWTGIDRLRLDKFYMLMRMVLNESLKVLKMQGWEERQIEELLELLMTEILHPSSQAPNGVKSHFIEIFLEELTKVGAEELTADQNLKFIDPFCRIAARTKDSLVLNNITRGIFETIVEQAPLAIEDLLNELDTQDEEVASDSDESSEGGERGDALSQKRSEKPPAGSICRAEPEAGEEQAGDDRDSGGPVLQFDYEAVANRLFEMASRQSTPSQNRKRLYKVIRKLQDLAGGIFPEDEIPEKACRRLLEGRRQKKTKKQKRLLRLQQERGKGEKEPPSPGMERKRSRRRGVGADPEARAEAGEQPGTAERALLRDQPRGRGQRGARQRRRTPRPLTSARAKAANVQEPEKKKKRRE

SEQ ID NO: 847778 - protein, 345 aa, Homo sapiens [sequence omitted]

SEQ ID NO: 847779 - protein, 137 aa, Homo sapiens
SPRLPSPSSLHFFPPLLSLISGAAFRVGPLATRVWLACDALTRGNPGSAADHSGPGAAYLQWRGLSTVPGRAGGPWQEWGAEEAHGGPPTPRWEAFPVTLSMLNWPQGLGIHPFPCPELRAIEAVHLISHEAVASSL

SEQ ID NO: 847780 - protein, 100 aa, Homo sapiens
RKRAGAGERAGLGKRVKCVETRCPRRGLRSRPQVGVTLRLASPRGLSWAEPVRSPAGLLLPPPTWSPCLCPSPQSILSIEARVTSVGTKHTSFPLIPQPL

SEQ ID NO: 847781 - protein, 432 aa, Homo sapiens
QGRRAQEARAQCAGYQATPGQGVSAVGVMVSRVQLPPEIQLAQRLAGNEQVTRDRAVRKLRKYIVARTQRAAGGFTHDELLKVWKGLFYCMWMQDKPLLQEELGRTISQLVHAFQTTEAQHLFLQAFWQTMNREWTGIDRLRLDKFYMLMRMVLNESLKVLKMQGWEERQIEELLELLMTEILHPSSQAPNGVKSHFIEIFLEELTKVGAEELTADQNLKFIDPFCRIAARTKDSLVLNNITRGIFETIVEQAPLAIEDLLNELDTQDEEVASDSDESSEGGERGDALSQKRSEKPPAGSICRAEPEAGEEQAGDDRDSGGPVLQFDYEAVANRLFEMASRQSTPSQNRKRLYKVIRKLQDLAGGIFPEDEIPEKACRRLLEGRRQKKTKKQKRLLRLQQERGRTRGCVSHGAGVLTCLLLPWMGVTCSVSP

SEQ ID NO: 847782 - protein, 399 aa, Homo sapiens [sequence omitted]

SEQ ID NO: 847783 - protein, 399 aa, Homo sapiens [sequence omitted]

SEQ ID NO: 847784 - protein, 446 aa, Homo sapiens
PGEAGAGGACSVCWVPGDSGTGGLGRRRHGGFTHDELLKVWKGLFYCMWMQDKPLLQEELGRTISQLVHAFQTTEAQHLFLQAFWQTMNREWTGIDRLRLDKFYMLMRMVLNESLKVLKMQGWEERQIEELLELLMTEILHPSSQAPNGVKSHFIEIFLEELTKVGAEELTADQNLKFIDPFCRIAARTKDSLVLNNITRGIFETIVEQAPLAIEDLLNELDTQDEEVASDSDESSEGGERGDALSQKRSEKPPAGSICRAEPEAGEEQAGDDRDSGGPVLQFDYEAVANRLFEMASRQSTPSQNRKRLYKVIRKLQDLAGGIFPEDEIPEKACRRLLEGRRQKKTKKQKRLLRLQQERGKGEKEPPSPGMERKRSRRRGVGADPEARAEAGEQPGTAERALLRDQPRGRGQRGARQRRRTPRPLTSARAKAANVQEPEKKKKRRE

SEQ ID NO: 847785 - protein, 337 aa, Homo sapiens
TRERPPVVLKMQGWEERQIEELLELLMTEILHPSSQAPNGVKSHFIEIFLEELTKVGAEELTADQNLKFIDPFCRIAARTKDSLVLNNITRGIFETIVEQAPLAIEDLLNELDTQDEEVASDSDESSEGGERGDALSQKRSEKPPAGSICRAEPEAGEEQAGDDRDSGGPVLQFDYEAVANRLFEMASRQSTPSQNRKRLYKVIRKLQDLAGGIFPEDEIPEKACRRLLEGRRQKKTKKQKRLLRLQQERGKGEKEPPSPGMERKRSRRRGVGADPEARAEAGEQPGTAERALLRDQPRGRGQRGARQRRRTPRPLTSARAKAANVQEPEKKKKRRE

SEQ ID NO: 847786 - protein, 489 aa, Homo sapiens; identical to SEQ ID NO: 847777

SEQ ID NO: 847787 - protein, 359 aa, Homo sapiens [sequence omitted]

SEQ ID NO: 847788 - protein, 149 aa, Homo sapiens
SGPAPSPRPTHLVGDVLGLGGGRLRGGGRPAHHLGGDGGNLARGLGEGTRRLLSPSRRWGHVTRGRNQGAGRRHFGFGVPCGVAVAPQEGTRGAGRGAGRGAGSLATTRRRLGLRAQRWCREGAPPSRGWYRLSGRRVTRTGAGARPGV

SEQ ID NO: 847789 - protein, 432 aa, Homo sapiens; identical to SEQ ID NO: 847781

SEQ ID NO: 847790 - protein, 314 aa, Homo sapiens
QGRRAQEARAQCAGYQATPGQGVSAVGVMVSRVQLPPEIQLAQRLAGNEQVTRDRAVRKLRKYIVARTQRAAGGFTHDELLKVWKGLFYCMWMQDKPLLQEELGRTISQLVHAFQTTEAQHLFLQAFWQTMNREWTGIDRLRLDKFYMLMRMVLNESLKVLKMQGWEERQIEELLELLMTEILHPSSQAPNGVKSHFIEIFLEELTKVGAEELTADQNLKFIDPFCRIAARTKDSLVLNNITRGIFETIVEQAPLAIEDLLNELDTQDEEVASDSDESSEGGERGDALSQKRSEKPPAGGGHTAPGFSSGPVLG

SEQ ID NO: 847791 - protein, 472 aa, Homo sapiens
SGPAPSPRPTHLVGDVLGLGGGRLRGGGRPAHHLGGDGGNLARGLGEGTRRLLSPSGFTHDELLKVWKGLFYCMWMQDKPLLQEELGRTISQLVHAFQTTEAQHLFLQAFWQTMNREWTGIDRLRLDKFYMLMRMVLNESLKVLKMQGWEERQIEELLELLMTEILHPSSQAPNGVKSHFIEIFLEELTKVGAEELTADQNLKFIDPFCRIAARTKDSLVLNNITRGIFETIVEQAPLAIEDLLNELDTQDEEVASDSDESSEGGERGDALSQKRSEKPPAGSICRAEPEAGEEQAGDDRDSGGPVLQFDYEAVANRLFEMASRQSTPSQNRKRLYKVIRKLQDLAGGIFPEDEIPEKACRRLLEGRRQKKTKKQKRLLRLQQERGKGEKEPPSPGMERKRSRRRGVGADPEARAEAGEQPGTAERALLRDQPRGRGQRGARQRRRTPRPLTSARAKAANVQEPEKKKKRRE

SEQ ID NO: 847792 - protein, 431 aa, Homo sapiens
VSEDPPLLTAVYLLVFGTEAMIKKCAWGTQAHFWMQDKPLLQEELGRTISQLVHAFQTTEAQHLFLQAFWQTMNREWTGIDRLRLDKFYMLMRMVLNESLKVLKMQGWEERQIEELLELLMTEILHPSSQAPNGVKSHFIEIFLEELTKVGAEELTADQNLKFIDPFCRIAARTKDSLVLNNITRGIFETIVEQAPLAIEDLLNELDTQDEEVASDSDESSEGGERGDALSQKRSEKPPAGSICRAEPEAGEEQAGDDRDSGGPVLQFDYEAVANRLFEMASRQSTPSQNRKRLYKVIRKLQDLAGGIFPEDEIPEKACRRLLEGRRQKKTKKQKRLLRLQQERGKGEKEPPSPGMERKRSRRRGVGADPEARAEAGEQPGTAERALLRDQPRGRGQRGARQRRRTPRPLTSARAKAANVQEPEKKKKRRE

SEQ ID NO: 847793 - protein, 119 aa, Homo sapiens
HPRGESREWLWPSWPIATPHRKQRAPGGTFFYFQKNKRHSSGPKCVCKTRNGKWLLDGPQIFKVRWIPSLPTHLPPRPSRLHKNTEFAGPGKEGRRLKHKTSCYAPGTKTVPKKSPCIL

SEQ ID NO: 847794 - protein, 232 aa, Homo sapiens
MALASGPARRALAGSGQLGLGGFGAPRRGAYEWGVRSTRKSEPPPLDRVYEIPGLEPITFAGKMHFVPWLARPIFPPWDRGYKDPRFYRSPPLHEHPLYKDQACYIFHHRCRLLEGVKQALWLTKTKLIEGLPEKVLSLVDDPRNHIENQDECVLNVISHARLWQTTEEIPKRETYCPVIVDNLIQLCKSQILKHPSLARRICVQNSTFSATWNRESLLLQVRGSGWSPTEH

SEQ ID NO: 847795 - protein, 232 aa, Homo sapiens; identical to SEQ ID NO: 847794

SEQ ID NO: 847796 - protein, 232 aa, Homo sapiens; identical to SEQ ID NO: 847794

SEQ ID NO: 847797 - protein, 232 aa, Homo sapiens; identical to SEQ ID NO: 847794

SEQ ID NO: 847798 - protein, 232 aa, Homo sapiens; identical to SEQ ID NO: 847794

SEQ ID NO: 847799 - protein, 188 aa, Homo sapiens
EIVVDLEDAYFSTGHFAGKMHFVPWLARPIFPPWDRGYKDPRFYRSPPLHEHPLYKDQACYIFHHRCRLLEGVKQALWLTKTKLIEGLPEKVLSLVDDPRNHIENQDECVLNVISHARLWQTTEEIPKRETYCPVIVDNLIQLCKSQILKHPSLARRICVQNSTFSATWNRESLLLQVRGSGWSPTEH

SEQ ID NO: 847800 - protein, 165 aa, Homo sapiens
IQGRRLRLPPWDRGYKDPRFYRSPPLHEHPLYKDQACYIFHHRCRLLEGVKQALWLTKTKLIEGLPEKVLSLVDDPRNHIENQDECVLNVISHARLWQTTEEIPKRETYCPVIVDNLIQLCKSQILKHPSLARRICVQNSTFSATWNRESLLLQVRGSGWSPTEH

SEQ ID NO: 847801 - protein, 181 aa, Homo sapiens
EIVVDLEDAYFSTGHFAGKMHFVPWLARPIFPPWDRGYKDPRFYRSPPLHEHPLYKDQACYIFHHRCRLLEGVKQALWLTKTKLIEGLPEKVLSLVDDPRNHIENQDECVLNVISHARLWQTTEEIPKRETYCPVIVDNLIQLCKSQILKHPSLARRICVQNSTFSATWNRGRDVQRTQVF

SEQ ID NO: 847802 - protein, 131 aa, Homo sapiens
TWRGPGGGLEAIRSGVKQALWLTKTKLIEGLPEKVLSLVDDPRNHIENQDECVLNVISHARLWQTTEEIPKRETYCPVIVDNLIQLCKSQILKHPSLARRICVQNSTFSATWNRESLLLQVRGSGWSPTEH

SEQ ID NO: 847803 - protein, 72 aa, Homo sapiens
RPIFPPWDRGYKDPRFYRSPPLHEHPLYKDQACYIFHHRCRLLEGEAPGRAARDRVPLTSTDPDPLWLWARH

SEQ ID NO: 847804 - protein, 232 aa, Homo sapiens; identical to SEQ ID NO: 847794

SEQ ID NO: 847805 - protein, 232 aa, Homo sapiens; identical to SEQ ID NO: 847794

SEQ ID NO: 847806 - protein, 232 aa, Homo sapiens; identical to SEQ ID NO: 847794

SEQ ID NO: 847807 - protein, 232 aa, Homo sapiens; identical to SEQ ID NO: 847794

SEQ ID NO: 847808 - protein, 232 aa, Homo sapiens; identical to SEQ ID NO: 847794

SEQ ID NO: 847809 - protein, 232 aa, Homo sapiens; identical to SEQ ID NO: 847794

SEQ ID NO: 847810 - protein, 248 aa, Homo sapiens
KAKSDRVVGIGRSRGPRQRGGGPQETLCFPGPMLGLGGFGAPRRGAYEWGVRSTRKSEPPPLDRVYEIPGLEPITFAGKMHFVPWLARPIFPPWDRGYKDPRFYRSPPLHEHPLYKDQACYIFHHRCRLLEGVKQALWLTKTKLIEGLPEKVLSLVDDPRNHIENQDECVLNVISHARLWQTTEEIPKRETYCPVIVDNLIQLCKSQILKHPSLARRICVQNSTFSATWNRESLLLQVRGSGWSPTEH

SEQ ID NO: 847811 - protein, 131 aa, Homo sapiens; identical to SEQ ID NO: 847802

SEQ ID NO: 847812 - protein, 124 aa, Homo sapiens
TWRGPGGGLEAIRSGVKQALWLTKTKLIEGLPEKVLSLVDDPRNHIENQDECVLNVISHARLWQTTEEIPKRETYCPVIVDNLIQLCKSQILKHPSLARRICVQNSTFSATWNRGRDVQRTQVF

SEQ ID NO: 847813 - protein, 111 aa, Homo sapiens [sequence omitted]

SEQ ID NO: 847814 - protein, 188 aa, Homo sapiens; identical to SEQ ID NO: 847799

SEQ ID NO: 847815 - protein, 70 aa, Homo sapiens
SNCFNRKEIALHVSMPCYQKKENKGENWFIQNYNSKTRHQNTALADFLESNFSSILTCDGEPSRDKLFIS

SEQ ID NO: 847816 - protein, 121 aa, Homo sapiens
GFCHVGQAGLELLTSSDLPASASQNPGITGLSHHAWPVLICLSISFFVLLTKDMLLCLVGFFSCGFLNPIQPLVPSPASSHSFAQLLGLPLTHREQPPTMDCTVLFAPLNLSCLQNDTSAN

SEQ ID NO: 847817 - protein, 129 aa, Homo sapiens
MEDGGQREERKRNAKCGQPPRVKIEGSVMQVLDRRRQVGRAPQPPPQKRPPPGLSDPWGAGSASPRPHVAPAPMVPVPWMETASSGGQMWCSGIQSHFLPGHACPAASLAAFSPYLPGDPGWGTRAPGG

SEQ ID NO: 847818 - protein, 782 aa, Homo sapiens
MAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 847819 - protein, 108 aa, Homo sapiens
MAAAMETEQLGVEIFETADCEENIESQDRPKLEPFYVERYSWSQLKKLLADTRKYHGYMMAKAPHDFMFVKRNDPDGPHSDRIYYLGNKSLIDHDRFSKSKMPEIASS

SEQ ID NO: 847820 - protein, 898 aa, Homo sapiens
MWKRSEQMKIKSGKCNMAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVQLVNNRFKGVKYFRLNTLASLGYVVVVIDNRGSCHRGLKFEGAFKYKMGQIEIDDQVEGLQYLASRYDFIDLDRVGIHGWSYGGYLSLMALMQRSDIFRVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 847821 - protein, 892 aa, Homo sapiens
MCLVFLGKCNMAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVQLVNNRFKGVKYFRLNTLASLGYVVVVIDNRGSCHRGLKFEGAFKYKMGQIEIDDQVEGLQYLASRYDFIDLDRVGIHGWSYGGYLSLMALMQRSDIFRVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 847822 - protein, 898 aa, Homo sapiens; identical to SEQ ID NO: 847820

SEQ ID NO: 847823 - protein, 780 aa, Homo sapiens
MYEAGFEIGRGSLGSHTLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVQLVNNRFKGVKYFRLNTLASLGYVVVVIDNRGSCHRGLKFEGAFKYKMGQIEIDDQVEGLQYLASRYDFIDLDRVGIHGWSYGGYLSLMALMQRSDIFRVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 847824 - protein, 882 aa, Homo sapiens
MAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVQLVNNRFKGVKYFRLNTLASLGYVVVVIDNRGSCHRGLKFEGAFKYKMGQIEIDDQVEGLQYLASRYDFIDLDRVGIHGWSYGGYLSLMALMQRSDIFRVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 847825 - protein, 882 aa, Homo sapiens; identical to SEQ ID NO: 847824

SEQ ID NO: 847826 - protein, 831 aa, Homo sapiens
MAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVQLVNNRFKGVKYFRLNTLASLGYVVVVIDNRGSCHRGLKFEGAFKYKMVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 847827 - protein, 913 aa, Homo sapiens
MAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVQLVNNRFKGVKYFRLNTLASLGYVVVVIDNRGSCHRGLKFEGAFKYKMEALNATFYEMPHVLSAALGNDENPMFLLHSKAVTVFASVIGHAEEDMGIFSHSQFFDLMLYSHGQIEIDDQVEGLQYLASRYDFIDLDRVGIHGWSYGGYLSLMALMQRSDIFRVAIAGAPVTLWIFYDTGYTERYMGHPDQNEQGYYLGSVAMQAEKFPSEPNRLLLLHGFLDENVHFAHTSILLSFLVRAGKPYDLQVSYSTFSS

SEQ ID NO: 847828 - protein, 241 aa, Homo sapiens [sequence omitted]

SEQ ID NO: 847829 - protein, 882 aa, Homo sapiens; identical to SEQ ID NO: 847824

SEQ ID NO: 847830 - protein, 709 aa, Homo sapiens
MAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVQLVNNRFKGVKYFRLNTLASLGYVVVVIDNRGSCHRGLKFEGAFKYKMGQIEIDDQVEGLQYLASRYDFIDLDRVGIHGWSYGGYLSLMALMQRSDIFRVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 847831 - protein, 898 aa, Homo sapiens; identical to SEQ ID NO: 847820

SEQ ID NO: 847832 - protein, 831 aa, Homo sapiens; identical to SEQ ID NO: 847826

SEQ ID NO: 847833 - protein, 613 aa, Homo sapiens
MAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGAVGE

SEQ ID NO: 847834 - protein, 833 aa, Homo sapiens
MAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQGQIEIDDQVEGLQYLASRYDFIDLDRVGIHGWSYGGYLSLMALMQRSDIFRVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 847835 - protein, 713 aa, Homo sapiens
MAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVQLVNNRFKGVKYFRLNTLASLGYVVVVIDNRGSCHRGLKFEGAFKYKMEALNATF

SEQ ID NO: 847836 - protein, 624 aa, Homo sapiens
MNSGGGFGLGLGFGLTPTSVIQVTNLSSAVTSEQMRTLFSFLGEIEELRLYPPDNAPLAFSSKVCYVKFRDPSSVGVAQHLTNTVFIDRALIVVPCAEGKIPEESKALSLLAPAPTMTSLMPGAGLLPIPTPNPLTTLGVSLSSLGAIPAAALDPNIATLGEIPQPPLMGNVDPSKIDEIRRTVYVGNLNSQTTTADQLLEFFKQVGEVKFVRMAGDETQPTRFAFVEFADQNSVPRALAFNGVMFGDRPLKINHSNNAIVKPPEMTPQAAAKELEEVMKRVREAQSFISAAIEPESGKSNERKGGRSRSHTRSKSRSSSKSHSRRKRSQSKHRSRSHNRSRSRQKDRRRSKSPHKKRSKSRERRKSRSRSHSRDKRKDTREKIKEKERVKEKDREKEREREKEREKEKERGKNKDRDKEREKDREKDKEKDREREREKEHEKDRDKEKEKEQDKEKEREKDRSKEIDEKRKKDKKSRTPPRSYNASRRSRSSSRERRRRRSRSSSRSPRTSKTIKRKSSRSPSPRSRNKKDKKREKERDHISERRERERSTSMRKSSNDRDGKEKLEKNSTSLKEKEHNKEPDSSVSKEVDDKDAPRTEENKIQHNGNCQLNEENLSTKTEAV

SEQ ID NO: 847837 - protein, 508 aa, Homo sapiens
MTSLMPGAGLLPIPTPNPLTTLGVSLSSLGAIPAAALDPNIATLGEIPQPPLMGNVDPSKIDEIRRTVYVGNLNSQTTTADQLLEFFKQVGEVKFVRMAGDETQPTRFAFVEFADQNSVPRALAFNGVMFGDRPLKINHSNNAIVKPPEMTPQAAAKELEEVMKRVREAQSFISAAIEPESGKSNERKGGRSRSHTRSKSRSSSKSHSRRKRSQSKHRSRSHNRSRSRQKDRRRSKSPHKKRSKSRERRKSRSRSHSRDKRKDTREKIKEKERVKEKDREKEREREKEREKEKERGKNKDRDKEREKDREKDKEKDREREREKEHEKDRDKEKEKEQDKEKEREKDRSKEIDEKRKKDKKSRTPPRSYNASRRSRSSSRERRRRRSRSSSRSPRTSKTIKRKSSRSPSPRSRNKKDKKREKERDHISERRERERSTSMRKSSNDRDGKEKLEKNSTSLKEKEHNKEPDSSVSKEVDDKDAPRTEENKIQHNGNCQLNEENLSTKTEAV

SEQ ID NO: 847838 - protein, 508 aa, Homo sapiens; identical to SEQ ID NO: 847837

SEQ ID NO: 847839 - protein, 508 aa, Homo sapiens; identical to SEQ ID NO: 847837

SEQ ID NO: 847840 - protein, 624 aa, Homo sapiens; identical to SEQ ID NO: 847836

SEQ ID NO: 847841 - protein, 624 aa, Homo sapiens; identical to SEQ ID NO: 847836

SEQ ID NO: 847842 - protein, 624 aa, Homo sapiens; identical to SEQ ID NO: 847836

SEQ ID NO: 847843 - protein, 311 aa, Homo sapiens
MNSGGGFGLGLGFGLTPTSVIQVTNLSSAVTSEQMRTLFSFLGEIEELRLYPPDNAPLAFSSKVCYVKFRDPSSVGVAQHLTNTVFIDRALIVVPCAEGKIPEESKALSLLAPAPTMTSLMPGAGLLPIPTPNPLTTLGVSLSSLGAIPAAALDPNIATLGEIPQPPLMGNVDPSKIDEIRRTVYVGNLNSQTTTADQLLEFFKQVGEVKFVRMAGDETQPTRFAFVEFADQNSVPRALAFNGVMFGDRPLKINHSNNAIVKPPEMTPQAAAKELEEVMKRVREAQSFISAAIEPGWLHSTSLCNDFLGCF

SEQ ID NO: 847844 - protein, 113 aa, Homo sapiens
MNSGGGFGLGLGFGLTPTSVIQVTNLSSAVTSEQMRTLFSFLGEIEELRLYPPDNAPLAFSSKVCYVKFRDPSSVGVAQHLTNTVFIDRALIVVPCAEDDYDWPRQTCYTCLS

SEQ ID NO: 847845 - protein, 87 aa, Homo sapiens
MNSGGGFGLGLGFGLTPTSVIQVTNLSSAVTSEQMRTLFSFLGEIEELRLYPPDQRTLFIFPTNIVYDKLSSMPFNAGVVVAPISNI

SEQ ID NO: 847846 - protein, 108 aa, Homo sapiens
MNSGGGFGLGLGFGLTPTSVIQVTNLSSAVTSEQMRTLFSFLGEIEELRLYPPDNAPLAFSSKVCYVKFRDPSSVGVAQHLTNTVFIDRALIVVPCAEGWYLAFFPLI

SEQ ID NO: 847847 - protein, 624 aa, Homo sapiens; identical to SEQ ID NO: 847836

SEQ ID NO: 847848 - protein, 508 aa, Homo sapiens; identical to SEQ ID NO: 847837

SEQ ID NO: 847849 - protein, 311 aa, Homo sapiens; identical to SEQ ID NO: 847843

SEQ ID NO: 847850 - protein, 359 aa, Homo sapiens
MTPQAAAKELEEVMKRVREAQSFISAAIEPESGKSNERKGGRSRSHTRSKSRSSSKSHSRRKRSQSKHRSRSHNRSRSRQKDRRRSKSPHKKRSKSRERRKSRSRSHSRDKRKDTREKIKEKERVKEKDREKEREREKEREKEKERGKNKDRDKEREKDREKDKEKDREREREKEHEKDRDKEKEKEQDKEKEREKDRSKEIDEKRKKDKKSRTPPRSYNASRRSRSSSRERRRRRSRSSSRSPRTSKTIKRKSSRSPSPRSRNKKDKKREKERDHISERRERERSTSMRKSSNDRDGKEKLEKNSTSLKEKEHNKEPDSSVSKEVDDKDAPRTEENKIQHNGNCQLNEENLSTKTEAV

SEQ ID NO: 847851 - protein, 152 aa, Homo sapiens
MEAAEQARNALQVDLAEAEKRREALWEKNTHLEAQLQKAEEAGAELQEISGTSKNRNKKDKKREKERDHISERRERERSTSMRKSSNDRDGKEKLEKNSTSLKEKEHNKEPDSSVSKEVDDKDAPRTEENKIQHNGNCQLNEENLSTKTEAV

SEQ ID NO: 847852 - protein, 311 aa, Homo sapiens; identical to SEQ ID NO: 847843

SEQ ID NO: 847853 - protein, 128 aa, Homo sapiens
MNSGGGFGLGLGFGLTPTSVIQVTNLSSAVTSEQMRTLFSFLGEIEELRLYPPEVSAGARLGEGRGRHRDLGSRGVEESADAGARCMSRDRAGLPWCPYLIRAPGFRRPALLSRIWGVNYCTEPLPRI

SEQ ID NO: 847854 - protein, 615 aa, Homo sapiens
QSRAGPYRQAIALMAALAAAAKKVWSARRLLVLLFTPLALLPVVFALPPKEGRCLFVILLMAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAAVRRNGLHTVPTEMQFLASTEAKDHPGETEVPLDLPADSRKEDEYRRNIWKGFLISIPYSASIGGTATLTGTAPNLILLGQLKSFFPQCDVVNFGSWFIFAFPLMLLFLLAGWLWISFLYGGLSFRGWRKNKSEIRTNAEDRARAVIREEYQNLGPIKFAEQAVFILFCMFAILLFTRDPKFIPGWASLFNPGFLSDAVTGVAIVTILFFFPSQRPSLKWWFDFKAPNTETEPLLTWKKAQETVPWNIILLLGGGFAMAKGCEESGLSVWIGGQLHPLENVPPALAVLLITVVIAFFTEFASNTATIIIFLPVLAELAIRLRVHPLYLMIPGTVGCSFAFMLPVSTPPNSIAFASGHLLVKDMVRTGLLMNLMGVLLLSLAMNTWAQTIFQLGTFPDWADMYSVNVTALPPTLANDTFRTL

SEQ ID NO: 847855 - protein, 555 aa, Homo sapiens
MAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAAVRRNGLHTVPTEMQFLASTEAKDHPGETEVPLDLPADSRKEDEYRRNIWKGFLISIPYSASIGGTATLTGTAPNLILLGQLKSFFPQCDVVNFGSWFIFAFPLMLLFLLAGWLWISFLYGGLSFRGWRKNKSEIRTNAEDRARAVIREEYQNLGPIKFAEQAVFILFCMFAILLFTRDPKFIPGWASLFNPGFLSDAVTGVAIVTILFFFPSQRPSLKWWFDFKAPNTETEPLLTWKKAQETVPWNIILLLGGGFAMAKGCEESGLSVWIGGQLHPLENVPPALAVLLITVVIAFFTEFASNTATIIIFLPVLAELAIRLRVHPLYLMIPGTVGCSFAFMLPVSTPPNSIAFASGHLLVKDMVRTGLLMNLMGVLLLSLAMNTWAQTIFQLGTFPDWADMYSVNVTALPPTLANDTFRTL

SEQ ID NO: 847856 - protein, 101 aa, Homo sapiens
FVTVRTRIAVLSLRPPVWWNSLPVSTPPNSIAFASGHLLVKDMVRTGLLMNLMGVLLLSLAMNTWAQTIFQLGTFPDWADMYSVNVTALPPTLANDTFRTL

SEQ ID NO: 847857 - protein, 223 aa, Homo sapiens
MNPLRRCPDGPLLGRVSESRVVLEFSRLPIVLFPFMGILPSNKVCPQYFLDTNFLFLSGLIMASAIEEWNLHRRIALKILMLVGVQPARLILGMMVTTSFLSMWLSNTASTAMMLPIANAIRLRVHPLYLMIPGTVGCSFAFMLPVSTPPNSIAFASGHLLVKDMVRTGLLMNLMGVLLLSLAMNTWAQTIFQLGTFPDWADMYSVNVTALPPTLANDTFRTL

SEQ ID NO: 847858 - protein, 615 aa, Homo sapiens; identical to SEQ ID NO: 847854

SEQ ID NO: 847859 - protein, 185 aa, Homo sapiens
MAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTGIEPNTFLSEERLKLQAPLVIRLGQITESGQWNMSGNDVCNFRVLSFLPGGM

SEQ ID NO: 847860 - protein, 476 aa, Homo sapiens
QSRAGPYRQAIALMAALAAAAKKVWSARRLLVLLFTPLALLPVVFALPPKEGRCLFVILLMAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAAVRRNGLHTVPTEMQFLASTEAKDHPGETEVPLDLPADSRKEDEYRRNIWKGFLISIPYSASIGGTATLTGTAPNLILLGQLKSFFPQCDVVNFGSWFIFAFPLMLLFLLAGWLWISFLYGGLSFRGWRKNKSEIRTNAEDRARAVIREEYQNLGPIKFAEQAVFILFCMFAILLFTRDPKFIPGWASLFNPGFLSDAVTGVAIVTILFFFPSQRPSLKWWFDFKGKVVKAGVSVGSVRTAAWSVVIKGLEPPTALTTWSFLLLLSLSEPLPCLGTEGCPRW

SEQ ID NO: 847861 - protein, 545 aa, Homo sapiens
QSRAGPYRQAIALMAALAAAAKKVWSARRLLVLLFTPLALLPVVFALPPKEGRCLFVILLMAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAAVRRNGLHTVPTEMQFLASTEAKDHPGETEVPLDLPADSRKEDEYRRNIWKGFLISIPYSASIGGTATLTGTAPNLILLGQLKSFFPQCDVVNFGSWFIFAFPLMLLFLLAGWLWISFLYGGLSFRGWRKNKSEIRTNAEDRARAVIREEYQNLGPIKFAEQAVFILFCMFAILLFTRDPKFIPGWASLFNPGFLSDAVTGVAIVTILFFFPSQRPSLKWWFDFKAPNTETEPLLTWKKAQETVPWNIILLLGGGFAMAKGCEESGLSVWIGGQLHPLENVPPALAVLLITVVIAFFTEFASNTATIIIFLPVLAELAIRLRVHPLYLMIPGTVGCSFAFMLPVSTPPNSK

SEQ ID NO: 847862 - protein, 185 aa, Homo sapiens; identical to SEQ ID NO: 847859

SEQ ID NO: 847863 - protein, 615 aa, Homo sapiens; identical to SEQ ID NO: 847854

SEQ ID NO: 847864 - protein, 413 aa, Homo sapiens
MGLHSSGKKWISEIKDHPGETEVPLDLPADSRKEDEYRRNIWKGFLISIPYSASIGGTATLTGTAPNLILLGQLKSFFPQCDVVNFGSWFIFAFPLMLLFLLAGWLWISFLYGGLSFRGWRKNKSEIRTNAEDRARAVIREEYQNLGPIKFAEQAVFILFCMFAILLFTRDPKFIPGWASLFNPGFLSDAVTGVAIVTILFFFPSQRPSLKWWFDFKAPNTETEPLLTWKKAQETVPWNIILLLGGGFAMAKGCEESGLSVWIGGQLHPLENVPPALAVLLITVVIAFFTEFASNTATIIIFLPVLAELAIRLRVHPLYLMIPGTVGCSFAFMLPVSTPPNSIAFASGHLLVKDMVRTGLLMNLMGVLLLSLAMNTWAQTIFQLGTFPDWADMYSVNVTALPPTLANDTFRTL

SEQ ID NO: 847865 - protein, 321 aa, Homo sapiens
ICNRSYENRCPLLAAASVVEFAQPVLGAQPHSRAQPLTSSCLASSRGWLWISFLYGGLSFRGWRKNKSEIRTNAEDRARAVIREEYQNLGPIKFLSDAVTGVAIVTILFFFPSQRPSLKWWFDFKAPNTETEPLLTWKKAQETVPWNIILLLGGGFAMAKGCEESGLSVWIGGQLHPLENVPPALAVLLITVVIAFFTEFASNTATIIIFLPVLAELAIRLRVHPLYLMIPGTVGCSFAFMLPVSTPPNSIAFASGHLLVKDMVRTGLLMNLMGVLLLSLAMNTWAQTIFQLGTFPDWADMYSVNVTALPPTLANDTFRTL

SEQ ID NO: 847866 - protein, 615 aa, Homo sapiens; identical to SEQ ID NO: 847854

SEQ ID NO: 847867 - protein, 401 aa, Homo sapiens
QSRAGPYRQAIALMAALAAAAKKVWSARRLLVLLFTPLALLPVVFALPPKEGRCLFVILLMAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAAVRRNGLHTVPTEMQFLASTEAKDHPGETEVPLDLPADSRKEDEYRRNIWKGFLISIPYSASIGGTATLTGTAPNLILLGQLKSFFPQCDVVNFGSWFIFAFPLMLLFLLAGWLWISFLYGGLSFRGWRKNKSEIRTNAEDRARAVIREEYQNLGPIKFAEQAVFILFCMFAILLFTRDPKFIPGWASLFNPGCKMGIISISTIQKM

SEQ ID NO: 847868 - protein, 352 aa, Homo sapiens
QSRAGPYRQAIALMAALAAAAKKVWSARRLLVLLFTPLALLPVVFALPPKEGRCLFVILLMAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAAVRRNGLHTVPTEMQFLASTEAKDHPGETEVPLDLPADSRKEDEYRRNIWKGFLISIPYSASIGGTATLTGTAPNLILLGQLKSFFPQCDVVNFGSWFIFAFPLMLLFLLAGWLWISFLYGGLSFRGWRKNKSEIRTNAEDRARARREQRFSYERLRF

SEQ ID NO: 847869 - protein, 1455 aa, Homo sapiens
MGGACSSFTTSSSPTIYSTSVTDSKAMQVESCSSAVGVSNRGVSEKQLTSNTVQQHPSTPKRHTVLYISPPPEDLLDNSRMSCQDEGCGLESEQSCSMWMEDSPSNFSNMSTSSYNDNTEVPRKSRKRNPKQRPGVKRRDCEESNMDIFDADSAKAPHYVLSQLTTDNKGNSKAGNGTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLAVDCVGILKLRNADVEARIGIAGSKKKSTRARLVFRVNIMRKDGSTLTLQTPSSPILCTQPAGVPEILKKSLHSCSVKGEEEVFLIGKNFLKGTKVIFQENVSDENSWKSEAEIDMELFHQNHLIVKVPPYHDQHITLPVSVGIYVVTNAGRSHDVQPFTYTPDPAAAGALNVNVKKEISSPARPCSFEEAMKAMKTTGCNLDKVNIIPNALMTPLIPSSMIKSEDVTPMEVTAEKRSSTIFKTTKSVGSTQQTLENISNIAGNGSFSSPSSSHLPSENEKQQQIHAKAYNPETLTTIQTQDISQPGTFPAVSASSQLPNSDALLQQATQFQTRETQSREILQSDGTVVNLSQLTEASQQQQQSPLQEQAQTLQQQISSNIFPSPNSVSQLQNTIQQLQAGSFTGSTASGSSGSVDLVQQVLEAQQQLSSVLFSAPDGNENVQEQLSADIFQQVSQIQSGVSPGMFSSTEPTVHTRPDNLLPGRAESVHPQSENTLSNQQQQQQQQQQVMESSAAMVMEMQQSICQAAAQIQSELFPSTASANGNLQQSPVYQQTSHMMSALSTNEDMQMQCELFSSPPAVSGNETSTTTTQQVATPGTTMFQTSSSGDGEETGTQAKQIQNSVFQTMVQMQHSGDNQPQVNLFSSTKSMMSVQNSGTQQQGNGLFQQGNEMMSLQSGNFLQQSSHSQAQLFHPQNPIADAQNLSQETQGSLFHSPNPIVHSQTSTTSSEQMQPPMFHSQSTIAVLQGSSVPQDQQSTNIFLSQSPMNNLQTNTVAQEAFFAAPNSISPLQSTSNSEQQAAFQQQAPISHIQTPMLSQEQAQPPQQGLFQPQVALGSLPPNPMPQSQQGTMFQSQHSIVAMQSNSPSQEQQQQQQQQQQQQQQQQQSILFSNQNTMATMASPKQPPPNMIFNPNQNPMANQEQQNQSIFHQQSNMAPMNQEQQPMQFQSQSTVSSLQNPGPTQSESSQTPLFHSSPQIQLVQGSPSSQEQQVTLFLSPASMSALQTSINQQDMQQSPLYSPQNNMPGIQGATSSPQPQATLFHNTAGGTMNQLQNSPGSSQQTSGMFLFGIQNNCSQLLTSGPATLPDQLMAISQPGQPQNEGQPPVTTLLSQQMPENSPLASSINTNQNIEKIDLLVSLQNQGNNLTGSF

SEQ ID NO: 847870 - protein, 1484 aa, Homo sapiens
MSQTSGGEAGSPPPAVVAADASSAPSSSSMGGACSSFTTSSSPTIYSTSVTDSKAMQVESCSSAVGVSNRGVSEKQLTSNTVQQHPSTPKRHTVLYISPPPEDLLDNSRMSCQDEGCGLESEQSCSMWMEDSPSNFSNMSTSSYNDNTEVPRKSRKRNPKQRPGVKRRDCEESNMDIFDADSAKAPHYVLSQLTTDNKGNSKAGNGTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLAVDCVGILKLRNADVEARIGIAGSKKKSTRARLVFRVNIMRKDGSTLTLQTPSSPILCTQPAGVPEILKKSLHSCSVKGEEEVFLIGKNFLKGTKVIFQENVSDENSWKSEAEIDMELFHQNHLIVKVPPYHDQHITLPVSVGIYVVTNAGRSHDVQPFTYTPDPAAAGALNVNVKKEISSPARPCSFEEAMKAMKTTGCNLDKVNIIPNALMTPLIPSSMIKSEDVTPMEVTAEKRSSTIFKTTKSVGSTQQTLENISNIAGNGSFSSPSSSHLPSENEKQQQIHAKAYNPETLTTIQTQDISQPGTFPAVSASSQLPNSDALLQQATQFQTRETQSREILQSDGTVVNLSQLTEASQQQQQSPLQEQAQTLQQQISSNIFPSPNSVSQLQNTIQQLQAGSFTGSTASGSSGSVDLVQQVLEAQQQLSSVLFSAPDGNENVQEQLSADIFQQVSQIQSGVSPGMFSSTEPTVHTRPDNLLPGRAESVHPQSENTLSNQQQQQQQQQQVMESSAAMVMEMQQSICQAAAQIQSELFPSTASANGNLQQSPVYQQTSHMMSALSTNEDMQMQCELFSSPPAVSGNETSTTTTQQVATPGTTMFQTSSSGDGEETGTQAKQIQNSVFQTMVQMQHSGDNQPQVNLFSSTKSMMSVQNSGTQQQGNGLFQQGNEMMSLQSGNFLQQSSHSQAQLFHPQNPIADAQNLSQETQGSLFHSPNPIVHSQTSTTSSEQMQPPMFHSQSTIAVLQGSSVPQDQQSTNIFLSQSPMNNLQTNTVAQEAFFAAPNSISPLQSTSNSEQQAAFQQQAPISHIQTPMLSQEQAQPPQQGLFQPQVALGSLPPNPMPQSQQGTMFQSQHSIVAMQSNSPSQEQQQQQQQQQQQQQQQQQSILFSNQNTMATMASPKQPPPNMIFNPNQNPMANQEQQNQSIFHQQSNMAPMNQEQQPMQFQSQSTVSSLQNPGPTQSESSQTPLFHSSPQIQLVQGSPSSQEQQVTLFLSPASMSALQTSINQQDMQQSPLYSPQNNMPGIQGATSSPQPQATLFHNTAGGTMNQLQNSPGSSQQTSGMFLFGIQNNCSQLLTSGPATLPDQLMAISQPGQPQNEGQPPVTTLLSQQMPENSPLASSINTNQNIEKIDLLVSLQNQGNNLTGSF

SEQ ID NO: 847871 - protein, 1455 aa, Homo sapiens; identical to SEQ ID NO: 847869

SEQ ID NO: 847872 - protein, 1455 aa, Homo sapiens
MGGACSSFTTSSSPTIYSTSVTDSKAMQVESCSSAVGVSNRGVSEKQLTSNTVQQHPSTPKRHTVLYISPPPEDLLDNSRMSCQDEGCGLESEQSCSMWMEDSPSNFSNMSTSSYNDNTEVPRKSRKRNPKQRPGVKRRDCEESNMDIFDADSAKAPHYVLSQLTTDNKGNSKAGNGTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLAVDCVGILKLRNADVEARIGIAGSKKKSTRARLVFRVNIMRKDGSTLTLQTPSSPILCTQPAGVPEILKKSLHSCSVKGEEEVFLIGKNFLKGTKVIFQENVSDENSWKSEAEIDMELFHQNHLIVKVPPYHDQHITLPVSVGIYVVTNAGRSHDVQPFTYTPDPAAAGALNVNVKKEISSPARPCSFEEAMKAMKTTGCNLDKVNIIPNALMTPLIPSSMIKSEDVTPMEVTAEKRSSTIFKTTKSVGSTQQTLENISNIAGNGSFSSPSSSHLPSENEKQQQIQPKAYNPETLTTIQTQDISQPGTFPAVSASSQLPNSDALLQQATQFQTRETQSREILQSDGTVVNLSQLTEASQQQQQSPLQEQAQTLQQQISSNIFPSPNSVSQLQNTIQQLQAGSFTGSTASGSSGSVDLVQQVLEAQQQLSSVLFSAPDGNENVQEQLSADIFQQVSQIQSGVSPGMFSSTEPTVHTRPDNLLPGRAESVHPQSENTLSNQQQQQQQQQQVMESSAAMVMEMQQSICQAAAQIQSELFPSTASANGNLQQSPVYQQTSHMMSALSTNEDMQMQCELFSSPPAVSGNETSTTTTQQVATPGTTMFQTSSSGDGEETGTQAKQIQNSVFQTMVQMQHSGDNQPQVNLFSSTKSMMSVQNSGTQQQGNGLFQQGNEMMSLQSGNFLQQSSHSQAQLFHPQNPIADAQNLSQETQGSLFHSPNPIVHSQTSTTSSEQMQPPMFHSQSTIAVLQGSSVPQDQQSTNIFLSQSPMNNLQTNTVAQEAFFAAPNSISPLQSTSNSEQQAAFQQQAPISHIQTPMLSQEQAQPPQQGLFQPQVALGSLPPNPMPQSQQGTMFQSQHSIVAMQSNSPSQEQQQQQQQQQQQQQQQQQSILFSNQNTMATMASPKQPPPNMIFNPNQNPMANQEQQNQSIFHQQSNMAPMNQEQQPMQFQSQSTVSSLQNPGPTQSESSQTPLFHSSPQIQLVQGSPSSQEQQVTLFLSPASMSALQTSINQQDMQQSPLYSPQNNMPGIQGATSSPQPQATLFHNTAGGTMNQLQNSPGSSQQTSGMFLFGIQNNCSQLLTSGPATLPDQLMAISQPGQPQNEGQPPVTTLLSQQMPENSPLASSINTNQNIEKIDLLVSLQNQGNNLTGSF

SEQ ID NO: 847873 - protein, 594 aa, Homo sapiens
MPSDFISLLSADLDLESPKSLYSRDSLKLHPSQNFHRAGLLEESVYDLLPKELQLPPSRETSVASMSQTSGGEAGSPPPAVVAADASSAPSSSSMGGACSSFTTSSSPTIYSTSVTDSKAMQVESCSSAVGVSNRGVSEKQLTSNTVQQHPSTPKRHTVLYISPPPEDLLDNSRMSCQDEGCGLESEQSCSMWMEDSPSNFSNMSTSSYNDNTEVPRKSRKRNPKQRPGVKRRDCEESNMDIFDADSAKAPHYVLSQLTTDNKGNSKAGNGTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLAVDCVGILKLRNADVEARIGIAGSKKKSTRARLVFRVNIMRKDGSTLTLQTPSSPILCTQPAGVPEILKKSLHSCSVKGEEEVFLIGKNFLKGTKVIFQENVSDENSWKSEAEIDMELFHQNHLIVKVPPYHDQHITLPVSVGIYVVTNAGRSHDVQPFTYTPDPAAAGALNVNVKKEISSPARPCSFEEAMKGTK

SEQ ID NO: 847874 - protein, 117 aa, Homo sapiens
MGLLASIGENMYSVFTLELYTADASSAPSSSSMGGACSSFTTSSSPTIYSTSVTDSKAMQVESCSSAVGVSNRGVSEKQLTSNTVQQHPSTPKRHTVLYISPPPEDLLDNSRMSCQD

SEQ ID NO: 847875 - protein, 1419 aa, Homo sapiens
MPSDFISLLSADLDLESPKSLYSRDSLKLHPSQNFHRAGLLEESVYDLLPKELQLPPSRETSVASMSQTSGGEAGSPPPAVVAADASSAPSSSSMGGACSSFTTSSSPTIYSTSVTDSKAMQVESCSSAVGVSNRGVSEKQLTSNTVQQHPSTPKRHTVLYISPPPEDLLDNSRMSCQDEGCGLESEQSCSMWMEDSPSNFSNMSTSSYNDNTEVPRKSRKRNPKQRPGVKRRDCEESNMDIFDADSAKAPHYVLSQLTTDNKGNSKAGNGTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLAVDCVGILKLRNADVEARIGIAGSKKKSTRARLVFRVNIMRKDGSTLTLQTPSSPILCTQPAGVPEILKKSLHSCSVKGEEEVFLIGKNFLKGTKVIFQENVSDENSWKSEAEIDMELFHQNHLIVKVPPYHDQHITLPVSVGIYVVTNAGRSHDVQPFTYTPDPAAAGALNVNVKKEISSPARPCSFEEAMKAMKTTGCNLDKVNIIPNALMTPLIPSSMIKSEDVTPMEVTAEKRSSTIFKTTKSVGSTQQTLENISNIAGNGSFSSPSSSHLPSENEKQQQIQPKAYNPETLTTIQTQDISQPGTFPAVSASSQLPNSDALLQQATQFQTRETQSREILQSDGTVVNLSQLTEASQQQQQSPLQEQAQTLQQQISSNIFPSPNSVSQLQNTIQQLQAGSFTGSTASGSSGSVDLVQQVLEAQQQLSSVLFSAPDGNENVQEQLSADIFQQVSQIQSGVSPGMFSSTEPTVHTRPDNLLPGRAESVHPQSENTLSNQQQQQQQQQQVMESSAAMVMEMQQSICQAAAQIQSELFPSTASANGNLQQSPVYQQTSHMMSALSTNEDMQMQCELFSSPPAVSGNETSTTTTQQVATPGTTMFQTSSSGDGEETGTQAKQIQNSVFQTMVQMQHSGDNQPQVNLFSSTKSMMSVQNSGTQQQGNGLFQQGNEMMSLQSGNFLQQSSHSQAQLFHPQNPIADAQNLSQETQGSLFHSPNPIVHSQTSTTSSEQMQPPMFHSQSTIAVLQGSSVPQDQQSTNIFLSQSPMNNLQTNTVAQEAFFAAPNSISPLQSTSNSEQQAAFQQQAPISHIQTPMLSQEQAQPPQQGLFQPQVALGSLPPNPMPQSQQGTMFQSQHSIVAMQSNSPSQEQQQQQQQQQQQQQQQQQSILFSNQNTMATMASPKQPPPNMIFNPNQNPMANQEQQNQSIFHQQSNMAPMNQEQQPMQFQSQSTVSSLQNPGPTQSESSQTPLFHSSPQIQLVQGSPSSQEQQVTLFLSPASMSALQTGRAEGDPGYDDDLQH

SEQ ID NO: 847876 - protein, 309 aa, Homo sapiens
MGLTVPLYTLLCKPQRVGGCPGDDTPVPCETPGQPGPSAAGLWGPSPARADLSLLSALSPALSSARGRPPQARRHQVVANTFSLPGAPARGHLPASPPPTLAAGPFPGSGTAAARAAPAGSEAHVAAVPWRASPPSGGRHGSSALPGTPLRACAVPHGGGAQIPVSGGGGGGDRQFSLRRNTKRTLWLSPFPFPVLNPSPGHRESVPVEFPLHLAIVSSVLGPVEVTTLEEEAAAAALASPPPVRCPRSRRGGAAATAAPPLPLPSGRAGSSCDALGLHLIAQRGPRPGIAQVPLLARFSEVTPITEFS

SEQ ID NO: 847877 - protein, 1531 aa, Homo sapiens
MPSDFISLLSADLDLESPKSLYSRESVYDLLPKELQLPPSRETSVASMSQTSGGEAGSPPPAVVAADASSAPSSSSMGGACSSFTTSSSPTIYSTSVTDSKAMQVESCSSAVGVSNRGVSEKQLTSNTVQQHPSTPKRHTVLYISPPPEDLLDNSRMSCQDEGCGLESEQSCSMWMEDSPSNFSNMSTSSYNDNTEVPRKSRKRNPKQRPGVKRRDCEESNMDIFDADSAKAPHYVLSQLTTDNKGNSKAGNGTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLAVDCVGILKLRNADVEARIGIAGSKKKSTRARLVFRVNIMRKDGSTLTLQTPSSPILCTQPAGVPEILKKSLHSCSVKGEEEVFLIGKNFLKGTKVIFQENVSDENSWKSEAEIDMELFHQNHLIVKVPPYHDQHITLPVSVGIYVVTNAGRSHDVQPFTYTPDPAAAGALNVNVKKEISSPARPCSFEEAMKAMKTTGCNLDKVNIIPNALMTPLIPSSMIKSEDVTPMEVTAEKRSSTIFKTTKSVGSTQQTLENISNIAGNGSFSSPSSSHLPSENEKQQQIQPKAYNPETLTTIQTQDISQPGTFPAVSASSQLPNSDALLQQATQFQTRETQSREILQSDGTVVNLSQLTEASQQQQQSPLQEQAQTLQQQISSNIFPSPNSVSQLQNTIQQLQAGSFTGSTASGSSGSVDLVQQVLEAQQQLSSVLFSAPDGNENVQEQLSADIFQQVSQIQSGVSPGMFSSTEPTVHTRPDNLLPGRAESVHPQSENTLSNQQQQQQQQQQVMESSAAMVMEMQQSICQAAAQIQSELFPSTASANGNLQQSPVYQQTSHMMSALSTNEDMQMQCELFSSPPAVSGNETSTTTTQQVATPGTTMFQTSSSGDGEETGTQAKQIQNSVFQTMVQMQHSGDNQPQVNLFSSTKSMMSVQNSGTQQQGNGLFQQGNEMMSLQSGNFLQQSSHSQAQLFHPQNPIADAQNLSQETQGSLFHSPNPIVHSQTSTTSSEQMQPPMFHSQSTIAVLQGSSVPQDQQSTNIFLSQSPMNNLQTNTVAQEAFFAAPNSISPLQSTSNSEQQAAFQQQAPISHIQTPMLSQEQAQPPQQGLFQPQVALGSLPPNPMPQSQQGTMFQSQHSIVAMQSNSPSQEQQQQQQQQQQQQQQQQQSILFSNQNTMATMASPKQPPPNMIFNPNQNPMANQEQQNQSIFHQQSNMAPMNQEQQPMQFQSQSTVSSLQNPGPTQSESSQTPLFHSSPQIQLVQGSPSSQEQQVTLFLSPASMSALQTSINQQDMQQSPLYSPQNNMPGIQGATSSPQPQATLFHNTAGGTMNQLQNSPGSSQQTSGMFLFGIQNNCSQLLTSGPATLPDQLMAISQPGQPQNEGQPPVTTLLSQQMPENSPLASSINTNQNIEKIDLLVSLQNQGNNLTGSF

SEQ ID NO: 847878 - protein, 1455 aa, Homo sapiens; identical to SEQ ID NO: 847869

SEQ ID NO: 847879 - protein, 451 aa, Homo sapiens
MEMQDLVIELKPEPDAQPQQAPRLGPFSPKEVSSAGRFGGEPHHSPGPMPAGAALLALGPRNPWTLWTPLTPNYPDRQPWTDKHPDLLTCGRCLQTFPLEAITAFMDHKKLGCQLFRGPSRGQGSEREELKALSCLRCGKQFTVAWKLLRHAQWDHGLSIYQTESEAPEAPLLGLAEVAAAVSAVVGPAAEAKSPRASGSGLTRRSPTCPVCKKTLSSFSNLKVHMRSHTGERPYACDQCPYACAQSSKLNRHKKTHRQVPPQSPLMADTSQEQASAAPPEPAVHAAAPTSTLPCSGGEGAGAAATAGVQEPGAPGSGAQAGPGGDTWGAITTEQRTDPANSQKASPKKMPKSGGKSRGPGGSCEFCGKHFTNSSNLTVHRRSHTGERPYTCEFCNYACAQSSKLNRHRRMHGMTPGSTRFECPHCHVPFGLRATLDKHLRQKHPEAAGEA

SEQ ID NO: 847880 - protein, 546 aa, Homo sapiens
MSRRKAGSAPRRVEPAPAANPDDEMEMQDLVIELKPEPDAQPQQAPRLGPFSPKEVSSAGRFGGEPHHSPGPMPAGAALLALGPRNPWTLWTPLTPNYPGEHPGPWAQPPLPLTLGWDPSLWAWAPRPALSPSPRPAPQAPFCPSVSPLLQHPQPPSWPHPTLTTRFLPADRQPWTDKHPDLLTCGRCLQTFPLEAITAFMDHKKLGCQLFRGPSRGQGSEREELKALSCLRCGKQFTVAWKLLRHAQWDHGLSIYQTESEAPEAPLLGLAEVAAAVSAVVGPAAEAKSPRASGSGLTRRSPTCPVCKKTLSSFSNLKVHMRSHTGERPYACDQCPYACAQSSKLNRHKKTHRQVPPQSPLMADTSQEQASAAPPEPAVHAAAPTSTLPCSGGEGAGAAATAGVQEPGAPGSGAQAGPGGDTWGAITTEQRTDPANSQKASPKKMPKSGGKSRGPGGSCEFCGKHFTNSSNLTVHRRSHTGERPYTCEFCNYACAQSSKLNRHRRMHGMTPGSTRFECPHCHVPFGLRATLDKHLRQKHPEAAGEA

SEQ ID NO: 847881 - protein, 96 aa, Homo sapiens
KVGGHTHTLVQREAHLMTHHGQQAAEVTLPKGGSCPLLLGFQGFLSYGTLLDFRNLWPQGGSASIRGKATAEAIRAPGQPEHRHGNVHWSLHCLGC

SEQ ID NO: 847882 - protein, 451 aa, Homo sapiens; identical to SEQ ID NO: 847879

SEQ ID NO: 847883 - protein, 151 aa, Homo sapiens [sequence omitted]

SEQ ID NO: 847884 - protein, 477 aa, Homo sapiens
PLFPNKAPGNFLPRSAPPARGSPAPGREAQMGEPRAGAALDDGSGWTGSEEGSEEGTGGSEGAGGDGGPDAEGVWSPDIEQSFQEALAIYPPCGRRKIILSDEGKMYGRNELIARYIKLRTGKTRTRKQVSSHIQVLARRKSREIQSKLKDQVSKDKAFQTMATMSSAQLISAPSLQAKLGPTGPQASELFQFWSGGSGPPWNVPDVKPFSQTPFTLSLTPPSTDLPGYEPPQALSPLPPPTPSPPAWQARGLGTARLQLVEFSAFVEPPDAVDSYQRHLFVHISQHCPSPGAPPLESVDVRQIYDKFPEKKGGLRELYDRGPPHAFFLVKFWADLNWGPSGEEAGAGGSISSGGFYGVSSQYESLEHMTLTCSSKVCSFGKQVVEKVETERAQLEDGRFVYRLLRSPMCEYLVNFLHKLRQLPERYMMNSVLENFTILQVVTNRDTQELLLCTAYVFEVSTSERGAQHHIYRLVRD

SEQ ID NO: 847885 - protein, 266 aa, Homo sapiens
PTFPKQSSRQLSPSQRPARPRLPSPRPGGRKAPAGVGDPALGCAQMGEPRAGAALDDGSGWTGSEEGSEEGTGGSEGAGGDGGPDAEGVWSPDIEQSFQEALAIYPPCGRRKIILSDEGKMYGRNELIARYIKLRTGKTRTRKQVSSHIQVLARRKSREIQSKLKDQVSKDKAFQTMATMSSAQLISAPSLQAKLGPTGPQASELFQFWSGGSGPPWNVPDVKPFSQTPFTLSLTPPSTDLPGRNSFPEAPQQISPNVSLARTVSH

SEQ ID NO: 847886 - protein, 447 aa, Homo sapiens
MGEPRAGAALDDGSGWTGSEEGSEEGTGGSEGAGGDGGPDAEGVWSPDIEQSFQEALAIYPPCGRRKIILSDEGKMYGRNELIARYIKLRTGKTRTRKQVSSHIQVLARRKSREIQSKLKDQVSKDKAFQTMATMSSAQLISAPSLQAKLGPTGPQASELFQFWSGGSGPPWNVPDVKPFSQTPFTLSLTPPSTDLPGYEPPQALSPLPPPTPSPPAWQARGLGTARLQLVEFSAFVEPPDAVDSYQRHLFVHISQHCPSPGAPPLESVDVRQIYDKFPEKKGGLRELYDRGPPHAFFLVKFWADLNWGPSGEEAGAGGSISSGGFYGVSSQYESLEHMTLTCSSKVCSFGKQVVEKVETERAQLEDGRFVYRLLRSPMCEYLVNFLHKLRQLPERYMMNSVLENFTILQVVTNRDTQELLLCTAYVFEVSTSERGAQHHIYRLVRD

SEQ ID NO: 847887 - protein, 554 aa, Homo sapiens
LPHTQESRPPAPAPSDPGVQAPDPPPSVLGVRAPAPPPSDSGVQAPDPPPSDPGIPPSSSSLRPRSPGPQPLLPQTQWSRVPALSASSPLRVGFGGSLLSSVFLQAQMGEPRAGAALDDGSGWTGSEEGSEEGTGGSEGAGGDGGPDAEGVWSPDIEQSFQEALAIYPPCGRRKIILSDEGKMYGRNELIARYIKLRTGKTRTRKQVSSHIQVLARRKSREIQSKLKDQVSKDKAFQTMATMSSAQLISAPSLQAKLGPTGPQASELFQFWSGGSGPPWNVPDVKPFSQTPFTLSLTPPSTDLPGYEPPQALSPLPPPTPSPPAWQARGLGTARLQLVEFSAFVEPPDAVDSYQRHLFVHISQHCPSPGAPPLESVDVRQIYDKFPEKKGGLRELYDRGPPHAFFLVKFWADLNWGPSGEEAGAGGSISSGGFYGVSSQYESLEHMTLTCSSKVCSFGKQVVEKVETERAQLEDGRFVYRLLRSPMCEYLVNFLHKLRQLPERYMMNSVLENFTILQVVTNRDTQELLLCTAYVFEVSTSERGAQHHIYRLVRD

SEQ ID NO: 847888 - protein, 571 aa, Homo sapiens
LPHTQESRPPAPAPSDPGVQAPDPPPSVLGVRAPAPPPSDSGVQAPDPPPSDPGIPPSSSSLRPRSPGPQPLLPQTQWSRVPALSASSPLRVGFGGSLLSSVFLQAQMGEPRAGAALDDGSGWTGSEEGSEEGTGGSEGAGGDGGPDAEGVWSPDIEQSFQEALAIYPPCGRRKIILSDEGKMYGRNELIARYIKLRTGKTRTRKQVSSHIQVLARRKSREIQSKLKDQVSKDKAFQTMATMSSAQLISAPSLQAKLGPTGPQASELFQFWSGGSGPPWNVPDVKPFSQTPFTLSLTPPSTDLPGYEPPQALSPLPPPTPSPPAWQARGLGTARLQLVEFSAFVEPPDAVDSYQRHLFVHISQHCPSPGAPPLESVDVRQIYDKFPEKKGGLRELYDRGPPHAFFLVKFWADLNWGPSGEEAGAGGSISSGGFYGVSSQYESLEHMTLTCSSKVCSFGKQVVEKVETERAQLEDGRFVYRLLRSPMCEYLVNFLHKLRQLPERYMMNSVLENFTILQVVTNRDTQELLLCTAYVFEVSTSERGAQHHKVKMNPFCAGAEPGGPWTFFFFLI

SEQ ID NO: 847889 - protein, 328 aa, Homo sapiens
LPHTQESRPPAPAPSDPGVQAPDPPPSVLGVRAPAPPPSDSGVQAPDPPPSDPGIPPSSSSLRPRSPGPQPLLPQTQWSRVPALSASSPLRVGFGGSLLSSVFLQAQMGEPRAGAALDDGSGWTGSEEGSEEGTGGSEGAGGDGGPDAEGVWSPDIEQSFQEALAIYPPCGRRKIILSDEGKMYGRNELIARYIKLRTGKTRTRKQVSSHIQVLARRKSREIQSKLKDQVSKDKAFQTMATMSSAQLISAPSLQAKLGPTGPQASELFQFWSGGSGPPWNVPDVKPFSQTPFTLSLTPPSTDLPGRNSFPEAPQQISPNVSLARTVSH

SEQ ID NO: 847890 - protein, 129 aa, Homo sapiens
VSQVHEPHLCSVATWSVVSSHMWALGTVLDGTDFHPIEHFHPWKVLLASAASPPRLWPPVPSPECWSFSSHPPNPSASSSSKFLVFCVFSLPSKTWFLFSPLSFYFFFEMESCSVTQEYNGVISAHCNI

SEQ ID NO: 847891 - protein, 554 aa, Homo sapiens; identical to SEQ ID NO: 847887

SEQ ID NO: 847892 - protein, 362 aa, Homo sapiens
PTFPKQSSRQLSPSQRPARPRLPSPRPGGRNELIARYIKLRTGKTRTRKQVSSHIQVLARRKSREIQSKLKASELFQFWSGGSGPPWNVPDVKPFSQTPFTLSLTPPSTDLPGYEPPQALSPLPPPTPSPPAWQARGLGTARLQLVEFSAFVEPPDAVDSYQRHLFVHISQHCPSPGAPPLESVDVRQIYDKFPEKKGGLRELYDRGPPHAFFLVKFWADLNWGPSGEEAGAGGSISSGGFYGVSSQYESLEHMTLTCSSKVCSFGKQVVEKVETERAQLEDGRFVYRLLRSPMCEYLVNFLHKLRQLPERYMMNSVLENFTILQVVTNRDTQELLLCTAYVFEVSTSERGAQHHIYRLVRD

SEQ ID NO: 847893 - protein, 294 aa, Homo sapiens
LPHTQESRPPAPAPSDPGVQAPDPPPSVLGVRAPAPPPSDSGVQAPDPPPSDPGIPPSSSSLRPRSPGPQPLLPQTQWSRVPALSASSPLRVGFGGSLLSSVFLQAQMGEPRAGAALDDGSGWTGSEEGSEEGTGGSEGAGGDGGPDAEGVWSPDIEQSFQEALAIYPPCGRRKIILSDEGKMYGRNELIARYIKLRTGKTRTRKQVSSHIQVLARRKSREIQSKLKDQVSKDKAFQTMATMSSAQLISAPSLQAKLGPTGPQASELFQFWSGGSGPPWNVPEFRRKKMFPRGV

SEQ ID NO: 847894 - protein, 207 aa, Homo sapiens
LPHTQESRPPAPAPSDPGVQAPDPPPSVLGVRAPAPPPSDSGVQAPDPPPSDPGIPPSSSSLRPRSPGPQPLLPQTQWSRVPALSASSPLRVGFGGSLLSSVFLQAQMGEPRAGAALDDGSGWTGSEEGSEEGTGGSEGAGGDGGPDAEGVWSPDIEQSFQASELFQFWSGGSGPPWNVPDVKPFSQTPFTLSLTPPSTDLPAARGS

SEQ ID NO: 847895 - protein, 40 aa, Homo sapiens
MDLWASVWDGPVFLGSSSHGQVQVQGRSCFLCVHLSSRHV

SEQ ID NO: 847896 - protein, 464 aa, Homo sapiens
SGWRGSGGRCGPGRAGAEAERAAGPAQPRPEPTMRRLRRLAHLVLFCPFSKRLQGRLPGLRVRCIFLAWLGVFAGSWLVYVHYSSYSERCRGHVCQVVICDQYRKGIISGSVCQDLCELHMVEWRTCLSVAPGQQVYSGLWRDKDVTIKCGIEETLDSKARSDAAPRRELVLFDKPTRGTSIKEFREMTLGFLKANLGDLPSLPALVGQVLLMADFNKDNRVSLAEAKSVWALLQRNEFLLLLSLQEKEHASRLLGYCGDLYLTEGVPHGAWHAAALPPLLRPLLPPALQGALQQWLGPAWPWRAKIAIGLLEFVEELFHGSYGTFYMCETTLANVGYTATYDFKMADLQQVAPEATVRRFLQGRRCEHSTDCTYGRDCRAPCDRLMRQCKGDLIQPNLAKVCALLRGYLLPGAPADLREELGTQLRTCTTLSGLASQVEAHHSLVLSHLKTLLWKKISNTKYS

SEQ ID NO: 847897 - protein, 464 aa, Homo sapiens; identical to SEQ ID NO: 847896

SEQ ID NO: 847898 - protein, 252 aa, Homo sapiens [sequence omitted]

SEQ ID NO: 847899 - protein, 464 aa, Homo sapiens; identical to SEQ ID NO: 847896

SEQ ID NO: 847900 - protein, 464 aa, Homo sapiens; identical to SEQ ID NO: 847896

SEQ ID NO: 847901 - protein, 373 aa, Homo sapiens
LVRGWGEHCDQYRKGIISGSVCQDLCELHMVEWRTCLSVAPGQQVYSGLWRDKDVTIKCGIEETLDSKARSDAAPRRELVLFDKPTRGTSIKEFREMTLGFLKANLGDLPSLPALVGQVLLMADFNKDNRVSLAEAKSVWALLQRNEFLLLLSLQEKEHASRLLGYCGDLYLTEGVPHGAWHAAALPPLLRPLLPPALQGALQQWLGPAWPWRAKIAIGLLEFVEELFHGSYGTFYMCETTLANVGYTATYDFKMADLQQVAPEATVRRFLQGRRCEHSTDCTYGRDCRAPCDRLMRQCKGDLIQPNLAKVCALLRGYLLPGAPADLREELGTQLRTCTTLSGLASQVEAHHSLVLSHLKTLLWKKISNTKYS

SEQ ID NO: 847902 - protein, 433 aa, Homo sapiens
AGLPLQPTAPSCSHQWHDPGPRHCLCEGLAAFQLQQVEAPASFGPVGKGLSGAGVWLPRPARLHLSPQCDQYRKGIISGSVCQDLCELHMVEWRTCLSVAPGQQVYSGLWRDKDVTIKCGIEETLDSKARSDAAPRRELVLFDKPTRGTSIKEFREMTLGFLKANLGDLPSLPALVGQVLLMADFNKDNRVSLAEAKSVWALLQRNEFLLLLSLQEKEHASRLLGYCGDLYLTEGVPHGAWHAAALPPLLRPLLPPALQGALQQWLGPAWPWRAKIAIGLLEFVEELFHGSYGTFYMCETTLANVGYTATYDFKMADLQQVAPEATVRRFLQGRRCEHSTDCTYGRDCRAPCDRLMRQCKGDLIQPNLAKVCALLRGYLLPGAPADLREELGTQLRTCTTLSGLASQVEAHHSLVLSHLKTLLWKKISNTKYS

SEQ ID NO: 847903 - protein, 336 aa, Homo sapiens
MKKEHVLHCQFSAWYPFFRGVTIKSVILPLPQNVKDYLLDDGTLVVSGRDDPPTHSQPDSDDEAEEIQWSDDENTATLTAPEFPEFATKVQEAINSLGGSVFPKLNWSAPRDAYWIAMNSSLKCKTLSDIFLLFKSSDFITRDFTQPFIHCTDDSPDPCIEYELVLRKWCELIPGAEFRCFVKENKLIGISQRDYTQYYDHISKQKEEIRRCIQDFFKKHIQYKFLDEDFVFDIYRDSRGKVWLIDFNPFGEVTDSLLFTWEELISENNLNGDFSEVDAQEQDSPAFRCTNSEVTVQPSPYLSYRLPKDFVDLSTGEDAHKLIDFLKLKRNQQEDD

SEQ ID NO: 847904 - protein, 124 aa, Homo sapiens
SSDPLNTTNSTLARPLTAYNPPLYRVPERTIPVRRLPHNSLPRPGPALIVSQLLGRSRSRAHKSALLAAYSPHSVIYTPRPTPPLIPFSNKDSQLRHAPRPVFQAPHPVPILTFQAWGRNNQKP

SEQ ID NO: 847905 - protein, 336 aa, Homo sapiens; identical to SEQ ID NO: 847903

SEQ ID NO: 847906 - protein, 360 aa, Homo sapiens
MKKEHVLHCQFSAWYPFFRGVTIKSVILPLPQNVKDYLLDDGTLVVSGRDDPPTHSQPDSDDEAEEIQWSDDENTATLTAPEFPEFATKVQEAINSLGGSVFPKLNWSAPRDAYWIAMNSSLKCKTLSDIFLLFKSSDFITRDFTQPFIHCTDDSPDPCIEYELVLRKWCELIPGAEFRCFVKENKLIGISQRDYTQYYDHISKQKEEIRRCIQDFFKKHIQYKFLDEDFFSVSQAGVQWCDRGSCSFHLPGSVVFDIYRDSRGKVWLIDFNPFGEVTDSLLFTWEELISENNLNGDFSEVDAQEQDSPAFRCTNSEVTVQPSPYLSYRLPKDFVDLSTGEDAHKLIDFLKLKRNQQEDD

SEQ ID NO: 847907 - protein, 336 aa, Homo sapiens; identical to SEQ ID NO: 847903

SEQ ID NO: 847908 - protein, 290 aa, Homo sapiens
MKKEHVLHCQFSAWYPFFRGVTIKSVILPLPQNVKDYLLDDGTLVVSGRDDPPTHSQPDSDDEAEEIQWSDDENTATLTAPEFPEFATKVQEAINSLGGSVFPKLNWSAPRDAYWIAMNSSLKCKTLSDIFLLFKSSDFITRDFTQPFIHCTDDSPDPCIEYELVLRKWCELIPGAEFRCFVKENKLIGISQRDYTQYYDHISKQKEEIRRCIQDFFKKHIQYKFLDEDFVFDIYRDSRGKVWLIDFNPFGEVTDSLLFTWEELISENNLNGDFSEVDAQEQKRNQQEDD

SEQ ID NO: 847909 - protein, 223 aa, Homo sapiens
MNVEARSGMSAGVPVVRSLQQVQSTSLHVFNLRRAIQLLLMILDPCIEYELVLRKWCELIPGAEFRCFVKENKLIGISQRDYTQYYDHISKQKEEIRRCIQDFFKKHIQYKFLDEDFVFDIYRDSRGKVWLIDFNPFGEVTDSLLFTWEELISENNLNGDFSEVDAQEQDSPAFRCTNSEVTVQPSPYLSYRLPKDFVDLSTGEDAHKLIDFLKLKRNQQEDD

SEQ ID NO: 847910 - protein, 293 aa, Homo sapiens
MKKEHVLHCQFSAWYPFFRGVTIKSVILPLPQNVKDYLLDDGTLVVSGRDDPPTHSQPDSDDEAEEIQWSDDENTATLTAPEFPEFATKVQEAINSLGGSVFPKLNWSAPRDAYWIAMNSSLKCKTLSDIFLLFKSSDFITRDFTQPFIHCTDDSPDPCIEYELVLRKWCELIPGAEFRCFVKENKLIGISQRDYTQYYDHISKQKEEIRRCIQDFFKKHIQYKFLDEDFVFDIYRDSRDSPAFRCTNSEVTVQPSPYLSYRLPKDFVDLSTGEDAHKLIDFLKLKRNQQEDD

SEQ ID NO: 847911 - protein, 109 aa, Homo sapiens
MFVFVFSLSVLQGKVWLIDFNPFGEVTDSLLFTWEELISENNLNGDFSEVDAQEQDSPAFRCTNSEVTVQPSPYLSYRLPKDFVDLSTGEDAHKLIDFLKLKRNQQEDD

SEQ ID NO: 847912 - protein, 336 aa, Homo sapiens; identical to SEQ ID NO: 847903

SEQ ID NO: 847913 - protein, 336 aa, Homo sapiens; identical to SEQ ID NO: 847903

SEQ ID NO: 847914 - protein, 336 aa, Homo sapiens; identical to SEQ ID NO: 847903

SEQ ID NO: 847915 - protein, 304 aa, Homo sapiens
MKKEHVLHCQFSAWYPFFRGVTIKSVILPLPQNVKDYLLDDGTLVVSGRDDPPTHSQPDSDDEAEEIQWSDDENTATLTDAYWIAMNSSLKCKTLSDIFLLFKSSDFITRDFTQPFIHCTDDSPDPCIEYELVLRKWCELIPGAEFRCFVKENKLIGISQRDYTQYYDHISKQKEEIRRCIQDFFKKHIQYKFLDEDFVFDIYRDSRGKVWLIDFNPFGEVTDSLLFTWEELISENNLNGDFSEVDAQEQDSPAFRCTNSEVTVQPSPYLSYRLPKDFVDLSTGEDAHKLIDFLKLKRNQQEDD

SEQ ID NO: 847916 - protein, 286 aa, Homo sapiens
MKKEHVLHCQFSAWYPFFRGVTIKSVILPLPQNVKDYLLDDGTLVVSGRDDPPTHSQPDSDDEAEEIQWSDDENTATLTAPEFPEFATKVQEAINSLGGSVFPKLNWSAPRDAYWIAMNSSLKCKTLSDIFLLFKSSDFITRDFTQPFIHCTDDSPDPCIEYELVLRKWCELIPGAEFRCFVKENKLIGISQRDYTQYYDHISKQKEEIRRCIQDFFKKHIQYKFLDEDFVFDIYRDSRGKVWLIDFNPFGEVTDSLLFTWEELISENNLNGDFSEVDAQEQVQHF

SEQ ID NO: 847917 - protein, 109 aa, Homo sapiens; identical to SEQ ID NO: 847911

SEQ ID NO: 847918 - protein, 144 aa, Homo sapiens
MKKEHVLHCQFSAWYPFFRGVTIKSVILPLPQNVKDYLLDDGTLVVSGRDDPPTHSQPDSDDEAEEIQWSDDENTATLTAPEFPEFATKVQEAINSLGGSVFPKLNWSAPRDAYWIAMNSSLKCKTLSDIFLLFKSSLSHSALT

SEQ ID NO: 847919 - protein, 1609 aa, Homo sapiens
MRGSHRAAPALRPRGRLWPVLAVLAAAAAAGCAQAAMDECTDEGGRPQRCMPEFVNAAFNVTVVATNTCGTPPEEYCVQTGVTGVTKSCHLCDAGQPHLQHGAAFLTDYNNQADTTWWQSQTMLAGVQYPSSINLTLHLGKAFDITYVRLKFHTSRPESFAIYKRTREDGPWIPYQYYSGSCENTYSKANRGFIRTGGDEQQALCTDEFSDISPLTGGNVAFSTLEGRPSAYNFDNSPVLQEWVTATDIRVTLNRLNTFGDEVFNDPKVLKSYYYAISDFAVGGRCKCNGHASECMKNEFDKLVCNCKHNTYGVDCEKCLPFFNDRPWRRATAESASECLPCDCNGRSQECYFDPELYRSTGHGGHCTNCQDNTDGAHCERCRENFFRLGNNEACSSCHCSPVGSLSTQCDSYGRCSCKPGVMGDKCDRCQPGFHSLTEAGCRPCSCDPSGSIDECNVETGRCVCKDNVEGFNCERCKPGFFNLESSNPRGCTPCFCFGHSSVCTNAVGYSVYSISSTFQIDEDGWRAEQRDGSEASLEWSSERQDIAVISDSYFPRYFIAPAKFLGKQVLSYGQNLSFSFRVDRRDTRLSAEDLVLEGAGLRVSVPLIAQGNSYPSETTVKYVFRLHEATDYPWRPALTPFEFQKLLNNLTSIKIRGTYSERSAGYLDDVTLASARPGPGVPATWVESCTCPVGYGGQFCEMCLSGYRRETPNLGPYSPCVLCACNGHSETCDPETGVCNCRDNTAGPHCEKCSDGYYGDSTAGTSSDCQPCPCPGGSSCAVVPKTKEVVCTNCPTGTTGKRCELCDDGYFGDPLGRNGPVRLCRLCQCSDNIDPNAVGNCNRLTGECLKCIYNTAGFYCDRCKDGFFGNPLAPNPADKCKACNCNPYGTMKQQSSCNPVTGQCECLPHVTGQDCGACDPGFYNLQSGQGCERCDCHALGSTNGQCDIRTGQCECQPGITGQHCERCEVNHFGFGPEGCKPCDCHPEGSLSLQCKDDGRCECREGFVGNRCDQCEENYFYNRSWPGCQECPACYRLVKDKVADHRVKLQELESLIANLGTGDEMVTDQAFEDRLKEAEREVMDLLREAQDVKDVDQNLMDRLQRVNNTLSSQISRLQNIRNTIEETGNLAEQARAHVENTERLIEIASRELEKAKVAAANVSVTQPESTGDPNNMTLLAEEARKLAERHKQEADDIVRVAKTANDTSTEAYNLLLRTLAGENQTAFEIEELNRKYEQAKNISQDLEKQAARVHEEAKRAGDKAVEIYASVAQLSPLDSETLENEANNIKMEAENLEQLIDQKLKDYEDLREDMRGKELEVKNLLEKGKTEQQTADQLLARADAAKALAEEAAKKGRDTLQEANDILNNLKDFDRRVNDNKTAAEEALRKIPAINQTITEANEKTREAQQALGSAAADATEAKNKAHEAERIASAVQKNATSTKAEAERTFAEVTDLDNEVNNMLKQLQEAEKELKRKQDDADQDMMMAGMASQAAQEAEINARKAKNSVTSLLSIINDLLEQLGQLDTVDLNKLNEIEGTLNKAKDEMKVSDLDRKVSDLENEAKKQEAAIMDYNRDIEEIMKDIRNLEDIRKTLPSGCFNTPSIEKP

SEQ ID NO: 847920 - protein, 1609 aa, Homo sapiens; identical to SEQ ID NO: 847919

SEQ ID NO: 847921 - protein, 158 aa, Homo sapiens
MRGSHRAAPALRPRGRLWPVLAVLAAAAAAGCAQAAMDECTDEGGRPQRCMPEFVNAAFNVTVVATNTCGTPPEEYCVQTGVTGVTKSCHLCDAGQPHLQHGAAFLTDYNNQADTTWWQSQTMLAGVQYPSSINLTLHLDDTWNKLHIKMSDMKIRRA

SEQ ID NO: 847922 - protein, 154 aa, Homo sapiens
MRGSHRAAPALRPRGRLWPVLAVLAAAAAAGCAQAAMDECTDEGGRPQRCMPEFVNAAFNVTVVATNTCGTPPEEYCVQTGVTGVTKSCHLCDAGQPHLQHGAAFLTDYNNQADTTWWQSQTMLAGVQYPSSINLTLHLVSATWEAEAEGSFEL

SEQ ID NO: 847923 - protein, 1540 aa, Homo sapiens
MRGSHRAAPALRPRGRLWPVLAVLAAAAAAGCAQAAMDECTDEGAAAAALHARVRQRRFQRDCGGHQHVWDSARGILCADRGDRGHQVLSPVRRRAAPPAARGSLPDRYSGSCENTYSKANRGFIRTGGDEQQALCTDEFSDISPLTGGNVAFSTLEGRPSAYNFDNSPVLQEWVTATDIRVTLNRLNTFGDEVFNDPKVLKSYYYAISDFAVGGRCKCNGHASECMKNEFDKLVCNCKHNTYGVDCEKCLPFFNDRPWRRATAESASECLPCDCNGRSQECYFDPELYRSTGHGGHCTNCQDNTDGAHCERCRENFFRLGNNEACSSCHCSPVGSLSTQCDSYGRCSCKPGVMGDKCDRCQPGFHSLTEAGCRPCSCDPSGSIDECNVETGRCVCKDNVEGFNCERCKPGFFNLESSNPRGCTPCFCFGHSSVCTNAVGYSVYSISSTFQIDEDGWRAEQRDGSEASLEWSSERQDIAVISDSYFPRYFIAPAKFLGKQVLSYGQNLSFSFRVDRRDTRLSAEDLVLEGAGLRVSVPLIAQGNSYPSETTVKYVFRLHEATDYPWRPALTPFEFQKLLNNLTSIKIRGTYSERSAGYLDDVTLASARPGPGVPATWVESCTCPVGYGGQFCEMCLSGYRRETPNLGPYSPCVLCACNGHSETCDPETGVCNCRDNTAGPHCEKCSDGYYGDSTAGTSSDCQPCPCPGGSSCAVVPKTKEVVCTNCPTGTTGKRCELCDDGYFGDPLGRNGPVRLCRLCQCSDNIDPNAVGNCNRLTGECLKCIYNTAGFYCDRCKDGFFGNPLAPNPADKCKACNCNPYGTMKQQSSCNPVTGQCECLPHVTGQDCGACDPGFYNLQSGQGCERCDCHALGSTNGQCDIRTGQCECQPGITGQHCERCEVNHFGFGPEGCKPCDCHPEGSLSLQCKDDGRCECREGFVGNRCDQCEENYFYNRSWPGCQECPACYRLVKDKVADHRVKLQELESLIANLGTGDEMVTDQAFEDRLKEAEREVMDLLREAQDVKDVDQNLMDRLQRVNNTLSSQISRLQNIRNTIEETGNLAEQARAHVENTERLIEIASRELEKAKVAAANVSVTQPESTGDPNNMTLLAEEARKLAERHKQEADDIVRVAKTANDTSTEAYNLLLRTLAGENQTAFEIEELNRKYEQAKNISQDLEKQAARVHEEAKRAGDKAVEIYASVAQLSPLDSETLENEANNIKMEAENLEQLIDQKLKDYEDLREDMRGKELEVKNLLEKGKTEQQTADQLLARADAAKALAEEAAKKGRDTLQEANDILNNLKDFDRRVNDNKTAAEEALRKIPAINQTITEANEKTREAQQALGSAAADATEAKNKAHEAERIASAVQKNATSTKAEAERTFAEVTDLDNEVNNMLKQLQEAEKELKRKQDDADQDMMMAGMASQAAQEAEINARKAKNSVTSLLSIINDLLEQLGQLDTVDLNKLNEIEGTLNKAKDEMKVSDLDRKVSDLENEAKKQEAAIMDYNRDIEEIMKDIRNLEDIRKTLPSGCFNTPSIEKP

SEQ ID NO: 847924 - protein, 1609 aa, Homo sapiens; identical to SEQ ID NO: 847919

SEQ ID NO: 847925 - protein, 718 aa, Homo sapiens [sequence omitted]

SEQ ID NO: 847926 - protein, 587 aa, Homo sapiens
ESWPCVKLVSASYRRVKDKVADHRVKLQELESLIANLGTGDEMVTDQAFEDRLKEAEREVMDLLREAQDVKDVDQNLMDRLQRVNNTLSSQISRLQNIRNTIEETGNLAEQARAHVENTERLIEIASRELEKAKVAAANVSVTQPESTGDPNNMTLLAEEARKLAERHKQEADDIVRVAKTANDTSTEAYNLLLRTLAGENQTAFEIEELNRKYEQAKNISQDLEKQAARVHEEAKRAGDKAVEIYASVAQLSPLDSETLENEANNIKMEAENLEQLIDQKLKDYEDLREDMRGKELEVKNLLEKGKTEQQTADQLLARADAAKALAEEAAKKGRDTLQEANDILNNLKDFDRRVNDNKTAAEEALRKIPAINQTITEANEKTREAQQALGSAAADATEAKNKAHEAERIASAVQKNATSTKAEAERTFAEVTDLDNEVNNMLKQLQEAEKELKRKQDDADQDMMMAGMASQAAQEAEINARKAKNSVTSLLSIINDLLEQLGQLDTVDLNKLNEIEGTLNKAKDEMKVSDLDRKVSDLENEAKKQEAAIMDYNRDIEEIMKDIRNLEDIRKTLPSGCFNTPSIEKP

SEQ ID NO: 847927 - protein, 1609 aa, Homo sapiens; identical to SEQ ID NO: 847919

SEQ ID NO: 847928 - protein, 976 aa, Homo sapiens
MRGSHRAAPALRPRGRLWPVLAVLAAAAAAGCAQAAMDECTDEGGRPQRCMPEFVNAAFNVTVVATNTCGTPPEEYCVQTGVTGVTKSCHLCDAGQPHLQHGAAFLTDYNNQADTTWWQSQTMLAGVQYPSSINLTLHLGKAFDITYVRLKFHTSRPESFAIYKRTREDGPWIPYQYYSGSCENTYSKANRGFIRTGGDEQQALCTDEFSDISPLTGGNVAFSTLEGRPSAYNFDNSPVLQEWVTATDIRVTLNRLNTFGDEVFNDPKVLKSYYYAISDFAVGGRCKCNGHASECMKNEFDKLVCNCKHNTYGVDCEKCLPFFNDRPWRRATAESASECLPCDCNGRSQECYFDPELYRSTGHGGHCTNCQDNTDGAHCERCRENFFRLGNNEACSSCHCSPVGSLSTQCDSYGRCSCKPGVMGDKCDRCQPGFHSLTEAGCRPCSCDPSGSIDECNVETGRCVCKDNVEGFNCERCKPGFFNLESSNPRGCTPCFCFGHSSVCTNAVGYSVYSISSTFQIDEDGWRAEQRDGSEASLEWSSERQDIAVISDSYFPRYFIAPAKFLGKQVLSYGQNLSFSFRVDRRDTRLSAEDLVLEGAGLRVSVPLIAQGNSYPSETTVKYVFRLHEATDYPWRPALTPFEFQKLLNNLTSIKIRGTYSERSAGYLDDVTLASARPGPGVPATWVESCTCPVGYGGQFCEMCLSGYRRETPNLGPYSPCVLCACNGHSETCDPETGVCNCRDNTAGPHCEKCSDGYYGDSTAGTSSDCQPCPCPGGSSCAVVPKTKEVVCTNCPTGTTGKRCELCDDGYFGDPLGRNGPVRLCRLCQCSDNIDPNAVGNCNRLTGECLKCIYNTAGFYCDRCKDGFFGNPLAPNPADKCKACNCNPYGTMKQQSSCNPVTGQCECLPHVTGQDCGACDPGFYNLQSGQGCESAKLVWVKFTPASLRPQWGGLVWFPFNFLFVICFSPPPVWYIF

SEQ ID NO: 847929 - protein, 976 aa, Homo sapiens; identical to SEQ ID NO: 847928

SEQ ID NO: 847930 - protein, 644 aa, Homo sapiens
MRGSHRAAPALRPRGRLWPVLAVLAAAAAAGCAQAAMDECTDEGGRPQRCMPEFVNAAFNVTVVATNTCGTPPEEYCVQTGVTGVTKSCHLCDAGQPHLQHGAAFLTDYNNQADTTWWQSQTMLAGVQYPSSINLTLHLGKAFDITYVRLKFHTSRPESFAIYKRTREDGPWIPYQYYSGSCENTYSKANRGFIRTGGDEQQALCTDEFSDISPLTGGNVAFSTLEGRPSAYNFDNSPVLQEWVTATDIRVTLNRLNTFGDEVFNDPKVLKSYYYAISDFAVGGRCKCNGHASECMKNEFDKLVCNCKHNTYGVDCEKCLPFFNDRPWRRATAESASECLPCDCNGRSQECYFDPELYRSTGHGGHCTNCQDNTDGAHCERCRENFFRLGNNEACSSCHCSPVGSLSTQCDSYGRCSCKPGVMGDKCDRCQPGFHSLTEAGCRPCSCDPSGSIDECNVETGRCVCKDNVEGFNCERCKPGFFNLESSNPRGCTPCFCFGHSSVCTNAVGYSVYSISSTFQIDEDGWRAEQRDGSEASLEWSSERQDIAVISDSYFPRYFIAPAKFLGKQVLSYGQNLSFSFRVDRRDTRLSAEDLVLEGAGLRVSVPLIAQGNSYPSETTVKYVFRLHEATDYPWSTDASGSSR

SEQ ID NO: 847931 - protein, 144 aa, Homo sapiens
KCVLELVSDFDRRVNDNKTAAEEALRKIPAINQTITEANEKTREAQQALGSAAADATEAKNKAHEAERIASAVQKNATSTKAEAERTFAEVTDLDNEVNNMLKQLQEAEKELKRKQDDADQDMMMAGMVRGFGIFAHWQKVNSV

SEQ ID NO: 847932 - protein, 1632 aa, Homo sapiens
MRGSHRAAPALRPRGRLWPVLAVLAAAAAAGCAQAAMDECTDEGGRPQRCMPEFVNAAFNVTVVATNTCGTPPEEYCVQTGVTGVTKSCHLCDAGQPHLQHGAAFLTDYNNQADTTWWQSQTMLAGVQYPSSINLTLHLGKAFDITYVRLKFHTSRPESFAIYKRTREDGPWIPYQYYSGSCENTYSKANRGFIRTGGDEQQALCTDEFSDISPLTGGNVAFSTLEGRPSAYNFDNSPVLQEWVTATDIRVTLNRLNTFGDEVFNDPKVLKSYYYAISDFAVGGRCKCNGHASECMKNEFDKLVCNCKHNTYGVDCEKCLPFFNDRPWRRATAESASECLPCDCNGRSQECYFDPELYRSTGHGGHCTNCQDNTDGAHCERCRENFFRLGNNEACSSCHCSPVGSLSTQCDSYGRCSCKPGVMGDKCDRCQPGFHSLTEAGCRPCSCDPSGSIDECNVETGRCVCKDNVEGFNCERCKPGFFNLESSNPRGCTPCFCFGHSSVCTNAVGYSVYSISSTFQIDEDGWRAEQRDGSEASLEWSSERQDIAVISDSYFPRYFIAPAKFLGKQVLSYGQNLSFSFRVDRRDTRLSAEDLVLEGAGLRVSVPLIAQGNSYPSETTVKYVFRLHEATDYPWRPALTPFEFQKLLNNLTSIKIRGTYSERSAGYLDDVTLASARPGPGVPATWVESCTCPVGYGGQFCEMCLSGYRRETPNLGPYSPCVLCACNGHSETCDPETGVCNCRDNTAGPHCEKCSDGYYGDSTAGTSSDCQPCPCPGGSSCAVVPKTKEVVCTNCPTGTTGKRCELCDDGYFGDPLGRNGPVRLCRLCQCSDNIDPNAVGNCNRLTGECLKCIYNTAGFYCDRCKDGFFGNPLAPNPADKCKACNCNPYGTMKQQSSCNPVTGQCECLPHVTGQDCGACDPGFYNLQSGQGCERCDCHALGSTNGQCDIRTGQCECQPGITGQHCERCEVNHFGFGPEGCKPCDCHPEGSLSLQCKDDGRCECREGFVGNRCDQCEENYFYNRSWPGCQECPACYRLVKDKVADHRVKLQELESLIANLGTGDEMVTDQAFEDRLKEAEREVMDLLREAQDVKGTHDGTVHDFCEMDQSLDVAPKEDVDQNLMDRLQRVNNTLSSQISRLQNIRNTIEETGNLAEQARAHVENTERLIEIASRELEKAKVAAANVSVTQPESTGDPNNMTLLAEEARKLAERHKQEADDIVRVAKTANDTSTEAYNLLLRTLAGENQTAFEIEELNRKYEQAKNISQDLEKQAARVHEEAKRAGDKAVEIYASVAQLSPLDSETLENEANNIKMEAENLEQLIDQKLKDYEDLREDMRGKELEVKNLLEKGKTEQQTADQLLARADAAKALAEEAAKKGRDTLQEANDILNNLKDFDRRVNDNKTAAEEALRKIPAINQTITEANEKTREAQQALGSAAADATEAKNKAHEAERIASAVQKNATSTKAEAERTFAEVTDLDNEVNNMLKQLQEAEKELKRKQDDADQDMMMAGMASQAAQEAEINARKAKNSVTSLLSIINDLLEQLGQLDTVDLNKLNEIEGTLNKAKDEMKVSDLDRKVSDLENEAKKQEAAIMDYNRDIEEIMKDIRNLEDIRKTLPSGCFNTPSIEKP

SEQ ID NO: 847933 - protein, 1609 aa, Homo sapiens; identical to SEQ ID NO: 847919

SEQ ID NO: 847934 - protein, 894 aa, Homo sapiens
MQLEADKILTLPKLLLRPVLRYFTDPAFDRAAGPHCEKCSDGYYGDSTAGTSSDCQPCPCPGGSSCAVVPKTKEVVCTNCPTGTTGKRCELCDDGYFGDPLGRNGPVRLCRLCQCSDNIDPNAVGNCNRLTGECLKCIYNTAGFYCDRCKDGFFGNPLAPNPADKCKACNCNPYGTMKQQSSCNPVTGQCECLPHVTGQDCGACDPGFYNLQSGQGCERCDCHALGSTNGQCDIRTGQCECQPGITGQHCERCEVNHFGFGPEGCKPCDCHPEGSLSLQCKDDGRCECREGFVGNRCDQCEENYFYNRSWPGCQECPACYRLVKDKVADHRVKLQELESLIANLGTGDEMVTDQAFEDRLKEAEREVMDLLREAQDVKDVDQNLMDRLQRVNNTLSSQISRLQNIRNTIEETGNLAEQARAHVENTERLIEIASRELEKAKVAAANVSVTQPESTGDPNNMTLLAEEARKLAERHKQEADDIVRVAKTANDTSTEAYNLLLRTLAGENQTAFEIEELNRKYEQAKNISQDLEKQAARVHEEAKRAGDKAVEIYASVAQLSPLDSETLENEANNIKMEAENLEQLIDQKLKDYEDLREDMRGKELEVKNLLEKGKTEQQTADQLLARADAAKALAEEAAKKGRDTLQEANDILNNLKDFDRRVNDNKTAAEEALRKIPAINQTITEANEKTREAQQALGSAAADATEAKNKAHEAERIASAVQKNATSTKAEAERTFAEVTDLDNEVNNMLKQLQEAEKELKRKQDDADQDMMMAGMASQAAQEAEINARKAKNSVTSLLSIINDLLEQLGQLDTVDLNKLNEIEGTLNKAKDEMKVSDLDRKVSDLENEAKKQEAAIMDYNRDIEEIMKDIRNLEDIRKTLPSGCFNTPSIEKP

SEQ ID NO: 847935 - protein, 1401 aa, Homo sapiens
MRGSHRAAPALRPRGRLWPVLAVLAAAAAAGCAQAAMDECTDEGGRPQRCMPEFVNAAFNVTVVATNTCGTPPEEYCVQTGVTGVTKSCHLCDAGQPHLQHGAAFLTDYNNQADTTWWQSQTMLAGVQYPSSINLTLHLGKAFDITYVRLKFHTSRPESFAIYKRTREDGPWIPYQYYSGSCENTYSKANRGFIRTGGDEQQALCTDEFSDISPLTGGNVAFSTLEGRPSAYNFDNSPVLQEWVTATDIRVTLNRLNTFGDEVFNDPKVLKSYYYAISDFAVGGRCKCNGHASECMKNEFDKLVCNCKHNTYGVDCEKCLPFFNDRPWRRATAESASECLPCDCNGRSQECYFDPELYRSTGHGGHCTNCQDNTDGAHCERCRENFFRLGNNEACSSCHCSPVGSLSTQCDSYGRCSCKPGVMGDKCDRCQPGFHSLTEAGCRPCSCDPSGSIDECNVETGRCVCKDNVEGFNCERCKPGFFNLESSNPRGCTPCFCFGHSSVCTNAVGYSVYSISSTFQIDEDGWRAEQRDGSEASLEWSSERQDIAVISDSYFPRYFIAPAKFLGKQVLSYGQNLSFSFRVDRRDTRLSAEDLVLEGAGLRVSVPLIAQGNSYPSETTVKYVFRLHEATDYPWRPALTPFEFQKLLNNLTSIKIRGTYSERSAGYLDDVTLASARPGPGVPATWVESCTCPVGYGGQFCEMCLSGYRRETPNLGPYSPCVLCACNGHSETCDPETGVCNCRDNTAGPHCEKCSDGYYGDSTAGTSSDCQPCPCPGGSSCAVVPKTKEVVCTNCPTGTTGKRCELCDDGYFGDPLGRNGPVRLCRLCQCSDNIDPNAVGNCNRLTGECLKCIYNTAGFYCDRCKDGFFGNPLAPNPADKCKACNCNPYGTMKQQSSCNPVTGQCECLPHVTGQDCGACDPGFYNLQSGQGCERCDCHALGSTNGQCDIRTGQCECQPGITGQHCERCEVNHFGFGPEGCKPCDCHPEGSLSLQCKDDGRCECREGFVGNRCDQCEENYFYNRSWPGCQECPACYRLVKDKVADHRVKLQELESLIANLGTGDEMVTDQAFEDRLKEAEREVMDLLREAQDVKDVDQNLMDRLQRVNNTLSSQISRLQNIRNTIEETGNLAEQARAHVENTERLIEIASRELEKAKVAAANVSVTQPESTGDPNNMTLLAEEARKLAERHKQEADDIVRVAKTANDTSTEAYNLLLRTLAGENQTAFEIEELNRKYEQAKNISQDLEKQAARVHEEAKRAGDKAVEIYASVAQLSPLDSETLENEANNIKMEAENLEQLIDQKLKDYEDLREDMRGKELEVKNLLEKGKTEQQTADQLLARADAAKALAEEAAKKGRDTLQEANDILNNLKDCDRRLLRMNKIVRTRTPLRKINTTPSENS

SEQ ID NO: 847936 - protein, 923 aa, Homo sapiens
MRGSHRAAPALRPRGRLWPVLAVLAAAAAAGCAQAAMDECTDEGGRPQRCMPEFVNAAFNVTVVATNTCGTPPEEYCVQTGVTGVTKSCHLCDAGQPHLQHGAAFLTDYNNQADTTWWQSQTMLAGVQYPSSINLTLHLGKAFDITYVRLKFHTSRPESFAIYKRTREDGPWIPYQYYSGSCENTYSKANRGFIRTGGDEQQALCTDEFSDISPLTGGNVAFSTLEGRPSAYNFDNSPVLQEWVTATDIRVTLNRLNTFGDEVFNDPKVLKSYYYAISDFAVGGRCKCNGHASECMKNEFDKLVCNCKHNTYGVDCEKCLPFFNDRPWRRATAESASECLPCDCNGRSQECYFDPELYRSTGHGGHCTNCQDNTDGAHCERCRENFFRLGNNEACSSCHCSPVGSLSTQCDSYGRCSCKPGVMGDKCDRCQPGFHSLTEAGCRPCSCDPSGSIDECNVETGRCVCKDNVEGFNCERCKPGFFNLESSNPRGCTPCFCFGHSSVCTNAVGYSVYSISSTFQIDEDGWRAEQRDGSEASLEWSSERQDIAVISDSYFPRYFIAPAKFLGKQVLSYGQNLSFSFRVDRRDTRLSAEDLVLEGAGLRVSVPLIAQGNSYPSETTVKYVFRLHEATDYPWRPALTPFEFQKLLNNLTSIKIRGTYSERSAGYLDDVTLASARPGPGVPATWVESCTCPVGYGGQFCEMCLSGYRRETPNLGPYSPCVLCACNGHSETCDPETGVCNCRDNTAGPHCEKCSDGYYGDSTAGTSSDCQPCPCPGGSSCAVVPKTKEVVCTNCPTGTTGKRCELCDDGYFGDPLGRNGPVRLCRLCQCSDNIDPNAVGNCNRLTGECLKCIYNTAGFYCDRCKDGFFGNPLAPNPADKCKACNCNPYGTMKQQSSCNPVTGQCECLPHVTGRTVVLALQGG

SEQ ID NO: 847937 - protein, 541 aa, Homo sapiens
MRGSHRAAPALRPRGRLWPVLAVLAAAAAAGCAQAAMDECTDEGGRPQRCMPEFVNAAFNVTVVATNTCGTPPEEYCVQTGVTGVTKSCHLCDAGQPHLQHGAAFLTDYNNQADTTWWQSQTMLAGVQYPSSINLTLHLGKAFDITYVRLKFHTSRPESFAIYKRTREDGPWIPYQYYSGSCENTYSKANRGFIRTGGDEQQALCTDEFSDISPLTGGNVAFSTLEGRPSAYNFDNSPVLQEWVTATDIRVTLNRLNTFGDEVFNDPKVLKSYYYAISDFAVGGRCKCNGHASECMKNEFDKLVCNCKHNTYGVDCEKCLPFFNDRPWRRATAESASECLPCDCNGRSQECYFDPELYRSTGHGGHCTNCQDNTDGAHCERCRENFFRLGNNEACSSCHCSPVGSLSTQCDSYGRCSCKPGVMGDKCDRCQPGFHSLTEAGCRPCSCDPSGSIDECNVETGRCVCKDNVEGFNCERCKPGFFNLESSNPRGCTPCFCFGHSSVCTNAVGYSVYSISSTFQIGNLDLIPQPVRTVRLHLKYF

SEQ ID NO: 847938 - protein, 422 aa, Homo sapiens
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWSTVEPAGLEEVITDAVAGLPHAVRVSARDFLDAGTWSTWSPEAWGTPSTGTIPKEIPAWGQLHTQPEVEPQVDSPAPPRPSLQPHPRLLDHRDSVEQVAVLASLGILSFLGLVAGALALGLWLRLRRGGKDGSPKPGFLASVIPVDRRPGAPNL

SEQ ID NO: 847939 - protein, 473 aa, Homo sapiens [sequence omitted]

SEQ ID NO: 847940 - protein, 422 aa, Homo sapiens; identical to SEQ ID NO: 847938

SEQ ID NO: 847941 - protein, 399 aa, Homo sapiens
MSLTSEVPSTGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWSTVEPAGLEEVITDAVAGLPHAVRVSARDFLDAGTWSTWSPEAWGTPSTGTIPKEIPAWGQLHTQPEVEPQVDSPAPPRPSLQPHPRLLDHRDSVEQVAVLASLGILSFLGLVAGALALGLWLRLRRGGKDGSPKPGFLASVIPVDRRPGAPNL

SEQ ID NO: 847942 - protein, 119 aa, Homo sapiens
MGQEPPYFTPLLPLAPGRSHPRCGGPGREGVEAGAEGEGEGRGRWRQRPRKMSSSCSGLSRVLVAVATALVSASSPCPQAWGPPGVQYGQPGRSVKLCCPGVTAGPSSPPCCLLPSSRL

SEQ ID NO: 847943 - protein, 389 aa, Homo sapiens
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWSTVEPAGLEEVITDAVAGLPHAVRVSARDFLDAGTWSTWSPEAWGTPSTGTIPKEIPAWGQLHTQPEVEPQVDSPAPPRPSLQPHPRLLDHRDSVEQVAVLASLGILSFLGLVAGALALGL

SEQ ID NO: 847944 - protein, 392 aa, Homo sapiens
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWSTVEPAGLEEVITDAVAGLPHAVRVSARDFLDAGTWSTWSPEAWGTPSTGTIPKEIPAWGQLHTQPEVEPQVDSPAPPRPSLQPHPRLLDHRDSVEQVAVLASLGILSFLGLVAGALALGLCGK

SEQ ID NO: 847945 - protein, 197 aa, Homo sapiens
MGWGFAVFKPQYPAKFENHCPTQPSFFFILSGVRGTFSFSNHLASGSCFQSCCSRVDRPSGGDPGIQLQTLSQAASSVRDGQEVSGGGGGGGDWQLESPMGQEPPYFTPLLPLAPGRSHPRCGGPGREGVEAGAEGEGEGRGRWRQRPRKMSSSCSGLSRVLVAVATALVSASSPCPQAWGPPGEKNPALQPPNSDL

SEQ ID NO: 847946 - protein, 131 aa, Homo sapiens
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTCISNLQLKGACTSDFTPELEFCSRNVCNVYICVHV

SEQ ID NO: 847947 - protein, 392 aa, Homo sapiens; identical to SEQ ID NO: 847944

SEQ ID NO: 847948 - protein, 399 aa, Homo sapiens; identical to SEQ ID NO: 847941

SEQ ID NO: 847949 - protein, 399 aa, Homo sapiens; identical to SEQ ID NO: 847941

SEQ ID NO: 847950 - protein, 290 aa, Homo sapiens
LLLLNEKPVDRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWSTVEPAGLEEVITDAVAGLPHAVRVSARDFLDAGTWSTWSPEAWGTPSTGTIPKEIPAWGQLHTQPEVEPQVDSPAPPRPSLQPHPRLLDHRDSVEQVAVLASLGILSFLGLVAGALALGLWLRLRRGGKDGSPKPGFLASVIPVDRRPGAPNL

SEQ ID NO: 847951 - protein, 197 aa, Homo sapiens; identical to SEQ ID NO: 847945

SEQ ID NO: 847952 - protein, 197 aa, Homo sapiens; identical to SEQ ID NO: 847945

SEQ ID NO: 847953 - protein, 164 aa, Homo sapiens
MGQEPPYFTPLLPLAPGRSHPRCGGPGREGVEAGAEGEGEGRGRWRQRPRKMSSSCSGLSRVLVAVATALVSASSPCPQAWGPPGVQYGQPGRSVKLCCPGVTAGDPVSWFRDGEPKLLQGPDSGLGHELVLAQADSTDEGTYICQKLEFCSRNVCNVYICVHV

SEQ ID NO: 847954 - protein, 570 aa, Homo sapiens
MESLGLHTVTLSDGTTAYVQQAVKGEKLLEGQVIQLEDGTTAYIHQVTVQKEALSFEDGQPVQLEDGSMAYIHRTPREGYDPSTLEAVQLEDGSTAYIHHPVAVPSESTILAVQTEVGLEDLAAEDDEGFSADAVVALEQYASKVLHDSQIPRNGKGQQVGDRAFRCGYKGCGRLYTTAHHLKVHERAHTGDRPYRCDFPSCGKAFATGYGLKSHVRTHTGEKPYKCPEELCSKAFKTSGDLQKHVRTHTGERPFQCPFEGCGRSFTTSNIRKVHVRTHTGERPYTCPEPHCGRGFTSATNYKNHVRIHTGEKPYVCTVPGCGKRFTEYSSLYKHHVVHTHCKPYTCSTCGKTYRQTSTLAMHKRSAHGELEATEESEQALYEQQQLEAASAAEESPPPKRPRIAYLSEVKEERDDIPAQVAMVTEEDGAPQVALITQDGAQQVSLSPEDLQALGSAISMVTQHGSTTLTIPSPDADLATSGTHTVTMVSADGTQTQPVTIITSGAVVAEDSSVASLRHQQVALLATANGTHIAVQLEEQQTLEEAINVATAAMQQGAVTLETTVSESGC

SEQ ID NO: 847955 - protein, 570 aa, Homo sapiens; identical to SEQ ID NO: 847954

SEQ ID NO: 847956 - protein, 570 aa, Homo sapiens; identical to SEQ ID NO: 847954

SEQ ID NO: 847957 - protein, 573 aa, Homo sapiens
AGLRRARFRSRPPGLQEPRNQDKLDGCRGEAGGGVDRARYFLYGFRGPVEARQEERKVRRPWNLDIARASCARAGGLWRRRVVGPALVAGPGAWRSVGGVALGGCQVPSESTILAVQTEVGLEDLAAEDDEGFSADAVVALEQYASKVLHDSQIPRNGKGQQVGDRAFRCGYKGCGRLYTTAHHLKVHERAHTGDRPYRCDFPSCGKAFATGYGLKSHVRTHTGEKPYKCPEELCSKAFKTSGDLQKHVRTHTGERPFQCPFEGCGRSFTTSNIRKVHVRTHTGERPYTCPEPHCGRGFTSATNYKNHVRIHTGEKPYVCTVPGCGKRFTEYSSLYKHHVVHTHCKPYTCSTCGKTYRQTSTLAMHKRSAHGELEATEESEQALYEQQQLEAASAAEESPPPKRPRIAYLSEVKEERDDIPAQVAMVTEEDGAPQVALITQDGAQQVSLSPEDLQALGSAISMVTQHGSTTLTIPSPDADLATSGTHTVTMVSADGTQTQPVTIITSGAVVAEDSSVASLRHQQVALLATANGTHIAVQLEEQQTLEEAINVATAAMQQGAVTLETTVSESGC

SEQ ID NO: 847958 - protein, 568 aa, Homo sapiens [sequence omitted]

SEQ ID NO: 847959 - protein, 532 aa, Homo sapiens
CVPPSSLGRIHIGISRLFPQVLHDSQIPRNGKGQQVGDRAFRCGYKGCGRLYTTAHHLKVRLLADSRQLCSLPSQAVILPFCFDWNWSLPSRCWREEMRVHRNASTERLTHMNGTGGKRIRVLKKTKEPWSYPCSSELCDCLSSQVHERAHTGDRPYRCDFPSCGKAFATGYGLKSHVRTHTGEKPYKCPEELCSKAFKTSGDLQKHVRTHTGERPFQCPFEGCGRSFTTSNIRKVHVRTHTGERPYTCPEPHCGRGFTSATNYKNHVRIHTGEKPYVCTVPGCGKRFTEYSSLYKHHVVHTHCKPYTCSTCGKTYRQTSTLAMHKRSAHGELEATEESEQALYEQQQLEAASAAEESPPPKRPRIAYLSEVKEERDDIPAQVAMVTEEDGAPQVALITQDGAQQVSLSPEDLQALGSAISMVTQHGSTTLTIPSPDADLATSGTHTVTMVSADGTQTQPVTIITSGAVVAEDSSVASLRHQQVALLATANGTHIAVQLEEQQTLEEAINVATAAMQQGAVTLETTVSESGC

SEQ ID NO: 847960 - protein, 75 aa, Homo sapiens
LNYVIACPHRCMNELIQVTVHTDVTSPAVERPLPQVTCLVGCFQLRVEGSRSVWDLSEGNPTPGCFPGETTVRVL

SEQ ID NO: 847961 - protein, 515 aa, Homo sapiens
MESLGLHTVTLSDGTTAYVQQAVKGEKLLEGQVIQLEDGTTAYIHQVTVQKEALSFEDGQPVQLEDGSMAYIHRTPREGYDPSTLEAVQLEDGSTAYIHHPVAVPSESTILAVQTEVGLEDLAAEDDEGFSADAVVALEQYASKVLHDSQIPRNGKGQQVGDRAFRCGYKGCGRLYTTAHHLKVHERAHTGDRPYRCDFPSCGKAFATGYGLKSHVRTHTGEKPYKCPEELCSKAFKTSGDLQKHVRTHTGERPFQCPFEGCGRSFTTSNIRKVHVRTHTGERPYTCPEPHCGRGFTSATNYKNHVRIHTGEKPYVCTVPGCGKRFTEYSSLYKHHVVHTHCKPYTCSTCGKTYRQTSTLAMHKRSAHGELEATEESEQALYEQQQLEAASAAEESPPPKRPRIAYLSEVKEERDDIPAQVAMVTEEDGAPQVALITQDGAQQVTIITSGAVVAEDSSVASLRHQQVALLATANGTHIAVQLEEQQTLEEAINVATAAMQQGAVTLETTVSESGC

SEQ ID NO: 847962 - protein, 570 aa, Homo sapiens; identical to SEQ ID NO: 847954

SEQ ID NO: 847963 - protein, 608 aa, Homo sapiens
MESLGLHTVTLSDGTTAYVQQAVKGEKLLEGQVIQLEDGTTAYIHQVTVQKGEGTTNTPCLVEGSLTAPTKGPLHGTELQGKAGIALVTEALSFEDGQPVQLEDGSMAYIHRTPREGYDPSTLEAVQLEDGSTAYIHHPVAVPSESTILAVQTEVGLEDLAAEDDEGFSADAVVALEQYASKVLHDSQIPRNGKGQQVGDRAFRCGYKGCGRLYTTAHHLKVHERAHTGDRPYRCDFPSCGKAFATGYGLKSHVRTHTGEKPYKCPEELCSKAFKTSGDLQKHVRTHTGERPFQCPFEGCGRSFTTSNIRKVHVRTHTGERPYTCPEPHCGRGFTSATNYKNHVRIHTGEKPYVCTVPGCGKRFTEYSSLYKHHVVHTHCKPYTCSTCGKTYRQTSTLAMHKRSAHGELEATEESEQALYEQQQLEAASAAEESPPPKRPRIAYLSEVKEERDDIPAQVAMVTEEDGAPQVALITQDGAQQVSLSPEDLQALGSAISMVTQHGSTTLTIPSPDADLATSGTHTVTMVSADGTQTQPVTIITSGAVVAEDSSVASLRHQQVALLATANGTHIAVQLEEQQTLEEAINVATAAMQQGAVTLETTVSESGC

SEQ ID NO: 847964 - protein, 446 aa, Homo sapiens
CVPPSSLGRIHIGISRLFPQVLHDSQIPRNGKGQQVGDRAFRCGYKGCGRLYTTAHHLKVHERAHTGDRPYRCDFPSCGKAFATGYGLKSHVRTHTGEKPYKCPEELCSKAFKTSGDLQKHVRTHTGERPFQCPFEGCGRSFTTSNIRKVHVRTHTGERPYTCPEPHCGRGFTSATNYKNHVRIHTGEKPYVCTVPGCGKRFTEYSSLYKHHVVHTHCKPYTCSTCGKTYRQTSTLAMHKRSAHGELEATEESEQALYEQQQLEAASAAEESPPPKRPRIAYLSEVKEERDDIPAQVAMVTEEDGAPQVALITQDGAQQVSLSPEDLQALGSAISMVTQHGSTTLTIPSPDADLATSGTHTVTMVSADGTQTQPVTIITSGAVVAEDSSVASLRHQQVALLATANGTHIAVQLEEQQTLEEAINVATAAMQQGAVTLETTVSESGC

SEQ ID NO: 847965 - protein, 499 aa, Homo sapiens
MESLGLHTVTLSDGTTAYVQQAVKGEKLLEGQVIQLEDGTTAYIHQVTVQKEALSFEDGQPVQLEDGSMAYIHRTPREGYDPSTLEAVQLEDGSTAYIHHPVAVPSESTILAVQTEVGLEDLAAEDDEGFSADAVVALEQYASKVLHDSQIPRNGKGQQVGDRAFRCGYKGCGRLYTTAHHLKVHERAHTGDRPYRCDFPSCGKAFATGYGLKSHVRTHTGEKPYKCPEELCSKAFKTSGDLQKHVRTHTGERPFQCPFEGCGRSFTTSNIRKVHVRTHTGERPYTCPEPHCGRGFTSATNYKNHVRIHTGEKPYVCTVPGCGKRFTEYSSLYKHHVVHTHCKPYTCSTCGKTYRQTSTLAMHKRSAHGELEATEESEQALYEQQQLEAASAAEESPPPKRPRIAYLSEVKEERDDIPAQVAMVTEEDGAPQVALITQDGAQQVSLSPEDLQALGSAISMVTQHGSTTLTIPSPDADLATSGTHTVTMVSADGTQTQPV

SEQ ID NO: 847966 - protein, 333 aa, Homo sapiens [sequence omitted]

SEQ ID NO: 847967 - protein, 192 aa, Homo sapiens
HGRRRVSGAPGPAYSAGVGGVGLGARAAAALCPLGTLLLGGAGRHGGGRRPLLGPSMPRPPRGYPACRSRAAAPGWRWGRAEAAEVLRATGGWQWAGERGRQARLGLGLWRRGTLCLGSLTAPPGSPERGTGGEGGGSWAPCAAGPRGARVAAGSAGPDRVNGRAWPVPRGAPAATALAAGTGVLRGRSLPF

SEQ ID NO: 847968 - protein, 192 aa, Homo sapiens; identical to SEQ ID NO: 847967

SEQ ID NO: 847969 - protein, 152 aa, Homo sapiens
MEGAGFPGLLAPLIPRGSAGSAWAPAPPLRFVRWAHCFWEGRADMVAAAAPSSALACRGRLAATRLAGPERQPRGGDGVAPRQRRFCGRLEVGSGREKEEGRRGWASASGAAVPKDFAAENCGCTASGKKLRILPGHLCQGTVHHCVFSVFR

SEQ ID NO: 847970 - protein, 253 aa, Homo sapiens
MEGAGFPGLLAPLIPRGSAGSAWAPAPPLRFVRWAHCFWEGRADMVAAAAPSSALACRGRLAATRLAGPERQPRGGDGVSAACCACCDVLLAGGDVDVFCACSVPCEEKHGRCMCWLCLCALLCPSFVSASVRYTLWIICVMAFDLVPPALGGLSSLWMDGWDNGVLCGGGIVLGVYACELALDCLCCVALIDGAAVLGDLLSCGIVVPCGPREPGGFKVAKENSRFVAQVRPAAVCGPTGQRQESNAHLRPG

SEQ ID NO: 847971 - protein, 763 aa, Homo sapiens
MEHHLQRAISAQQVYGEKRDNMVIPVPEAESNIAYYESIYPGEFKMPKQLIHIQPFSLDAEQPDYDLDSEDEVFVNKLKKKMDICPLQFEEMIDRLEKGSGQQPVSLQEAKLLLKEDDELIREVYEYWIKKRKNCRGPSLIPSVKQEKRDGSSTNDPYVAFRRRTEKMQTRKNRKNDEASYEKMLKLRRDLSRAVTILEMIKRREKSKRELLHLTLEIMEKRYNLGDYNGEIMSEVMAQRQPMKPTYAIPIIPITNSSQFKHQEAMDVKEFKVNKQDKADLIRPKRKYEKKPKVLPSSAAATPQQTSPAALPVFNAKDLNQYDFPSSDEEPLSQVLSGSSEAEEDNDPDGPFAFRRKAGCQYYAPHLDQTGNWPWTSPKDGGLGDVRYRYCLTTLTVPQRCIGFARRRVGRGGRVLLDRAHSDYDSVFHHLDLEMLSSPQHSPVNQFANTSETNTSDKSFSKDLSQILVNIKSCRWRHFRPRTPSLHDSDNDELSCRKLYRSINRTGTAQPGTQTCSTSTQSKSSSGSAHFAFTAEQYQQHQQQLALMQKQQLAQIQQQQANSNSSTNTSQGFVSKTLDSASAQFAASALVTSEQLMGFKMKDDVVLGIGVNGVLPASGVYKGLHLSSTTPTALVHTSPSTAGSALLQPSNITQTSSSHSALSHQVTAANSATTQVLIGNNIRLTVPSSVATVNSIAPINARHIPRTLSAVPSSALKLAAAANCQVSKVPSSSSVDSVPRENHESEKPALNNIADNTVAMEVT

SEQ ID NO: 847972 - protein, 103 aa, Homo sapiens
AGRARAAARCSVGNGWGWLKSAQWSFNVRHVGHGVLKRASERGAERHSLPPSRLVLVPGRRALRSAPQVPGSGWRVGTEPPVLHDPAGRGRFPRAERYLLRLR

SEQ ID NO: 847973 - protein, 836 aa, Homo sapiens
MSKLSFRARALDASKPLPVFRCEDLPDLHEYASINRAVPQMPTGMEKEEESEHHLQRAISAQQVYGEKRDNMVIPVPEAESNIAYYESIYPGEFKMPKQLIHIQPFSLDAEQPDYDLDSEDEVFVNKLKKKMDICPLQFEEMIDRLEKGSGQQPVSLQEAKLLLKEDDELIREVYEYWIKKRKNCRGPSLIPSVKQEKRDGSSTNDPYVAFRRRTEKMQTRKNRKNDEASYEKMLKLRRDLSRAVTILEMIKRREKSKRELLHLTLEIMEKRYNLGDYNGEIMSEVMAQRQPMKPTYAIPIIPITNSSQFKHQEAMDVKEFKVNKQDKADLIRPKRKYEKKPKVLPSSAAATPQQTSPAALPVFNAKDLNQYDFPSSDEEPLSQVLSGSSEAEEDNDPDGPFAFRRKAGCQYYAPHLDQTGNWPWTSPKDGGLGDVRYRYCLTTLTVPQRCIGFARRRVGRGGRVLLDRAHSDYDSVFHHLDLEMLSSPQHSPVNQFANTSETNTSDKSFSKDLSQILVNIKSCRWRHFRPRTPSLHDSDNDELSCRKLYRSINRTGTAQPGTQTCSTSTQSKSSSGSAHFAFTAEQYQQHQQQLALMQKQQLAQIQQQQANSNSSTNTSQNLASNQQKSGFRLNIQGLERTLQGFVSKTLDSASAQFAASALVTSEQLMGFKMKDDVVLGIGVNGVLPASGVYKGLHLSSTTPTALVHTSPSTAGSALLQPSNITQTSSSHSALSHQVTAANSATTQVLIGNNIRLTVPSSVATVNSIAPINARHIPRTLSAVPSSALKLAAAANCQVSKVPSSSSVDSVPRENHESEKPALNNIADNTVAMEVT

SEQ ID NO: 847974 - protein, 682 aa, Homo sapiens
MDICPLQFEEMIDRLEKGSGQQPVSLQEAKLLLKEDDELIREVYEYWIKKRKNCRGPSLIPSVKQEKRDGSSTNDPYVAFRRRTEKMQTRKNRKNDEASYEKMLKLRRDLSRAVTILEMIKRREKSKRELLHLTLEIMEKRYNLGDYNGEIMSEVMAQRQPMKPTYAIPIIPITNSSQFKHQEAMDVKEFKVNKQDKADLIRPKRKYEKKPKVLPSSAAATPQQTSPAALPVFNAKDLNQYDFPSSDEEPLSQVLSGSSEAEEDNDPDGPFAFRRKAGCQYYAPHLDQTGNWPWTSPKDGGLGDVRYRYCLTTLTVPQRCIGFARRRVGRGGRVLLDRAHSDYDSVFHHLDLEMLSSPQHSPVNQFANTSETNTSDKSFSKDLSQILVNIKSCRWRHFRPRTPSLHDSDNDELSCRKLYRSINRTGTAQPGTQTCSTSTQSKSSSGSAHFAFTAEQYQQHQQQLALMQKQQLAQIQQQQANSNSSTNTSQGFVSKTLDSASAQFAASALVTSEQLMGFKMKDDVVLGIGVNGVLPASGVYKGLHLSSTTPTALVHTSPSTAGSALLQPSNITQTSSSHSALSHQVTAANSATTQVLIGNNIRLTVPSSVATVNSIAPINARHIPRTLSAVPSSALKLAAAANCQVSKVPSSSSVDSVPRENHESEKPALNNIADNTVAMEVT

SEQ ID NO: 847975 - protein, 836 aa, Homo sapiens; identical to SEQ ID NO: 847973

SEQ ID NO: 847976 - protein, 166 aa, Homo sapiens
MGLLRDEALAEVKDMEQLLALGKEARACPYYGSRLAIPAAQLVVLPYQMLLHAATRQAAGIRLQDQVVIIDEAHNLIDTITGMHSVEVSGSQLCQAHSQLLQYVERYGVVKAKNLMYLKQILYLLEKFVAVLGGESLVPLLTPGLQNSLGCFFLGCPSGHLSSLCF

SEQ ID NO: 847977 - protein, 801 aa, Homo sapiens
MSKLSFRARALDASKPLPVFRCEDLPDLHEYASINRAVPQMPTGMEKEEESEHHLQRAISAQQVYGEKRDNMVIPVPEAESNIAYYESIYPGEFKMPKQLIHIQPFSLDAEQPDYDLDSEDEVFVNKLKKKMDICPLQFEEMIDRLEKGSGQQPVSLQEAKLLLKEDDELIREVYEYWIKKRKNCRGPSLIPSVKQEKRDGSSTNDPYVAFRRRTEKMQTRKNRKNDEASYEKMLKLRRDLSRAVTILEMIKRREKSKRELLHLTLEIMEKRYNLGDYNGEIMSEVMAQRQPMKPTYAIPIIPITNSSQFKHQEAMDVKEFKVNKQDKADLIRPKRKYEKKPKVLPSSAAATPQQTSPAALPVFNAKDLNQYDFPSSDEEPLSQVLSGSSEAEEDNDPDGPFAFRRKAGCQYYAPHLDQTGNWPWTSPKDGGLGDVRYRYCLTTLTVPQRCIGFARRRVGRGGRVLLDRAHSDYDSVFHHLDLEMLSSPQHSPVNQFANTSETNTSDKSFSKDLSQILVNIKSCRWRHFRPRTPSLHDSDNDELSCRKLYRSINRTGTAQPGTQTCSTSTQSKSSSGSAHFAFTAEQYQQHQQQLALMQKQQLAQIQQQQANSNSSTNTSQGFVSKTLDSASAQFAASALVTSEQLMGFKMKDDVVLGIGVNGVLPASGVYKGLHLSSTTPTALVHTSPSTAGSALLQPSNITQTSSSHSALSHQVTAANSATTQVLIGNNIRLTVPSSVATVNSIAPINARHIPRTLSAVPSSALKLAAAANCQVSKVPSSSSVDSVPRSLMLQFFFSYC

SEQ ID NO: 847978 - protein, 618 aa, Homo sapiens
MSKLSFRARALDASKPLPVFRCEDLPDLHEYASINRAVPQMPTGMEKEEESEHHLQRAISAQQVYGEKRDNMVIPVPEAESNIAYYESIYPGEFKMPKQLIHIQPFSLDAEQPDYDLDSEDEVFVNKLKKKMDICPLQFEEMIDRLEKGSGQQPVSLQEAKLLLKEDDELIREVYEYWIKKRKNCRGPSLIPSVKQEKRDGSSTNDPYVAFRRRTEKMQTRKNRKNDEASYEKMLKLRRDLSRAVTILEMIKRREKSKRELLHLTLEIMEKRYNLGDYNGEIMSEVMAQRQPMKPTYAIPIIPITNSSQFKHQEAMDVKEFKVNKQDKADLIRPKRKYEKKPKVLPSSAAATPQQTSPAALPVFNAKDLNQYDFPSSDEEPLSQVLSGSSEAEEDNDPDGPFAFRRKAGCQYYAPHLDQTGNWPWTSPKDGGLGDVRYRYCLTTLTVPQRCIGFARRRVGRGGRVLLDRAHSDYDSVFHHLDLEMLSSPQHSPVNQFANTSETNTSDKSFSKDLSQILVNIKSCRWRHFRPRTPSLHDSDNDELSCRKLYRSINRTGTAQPGTQTCSTSTQSKSSSGSAHFGMLTVNDVRFYRNVRSNHFPFVRLCGLLHLWLKVLFS

SEQ ID NO: 847979 - protein, 103 aa, Homo sapiens; identical to SEQ ID NO: 847972

SEQ ID NO: 847980 - protein, 103 aa, Homo sapiens; identical to SEQ ID NO: 847972

SEQ ID NO: 847981 - protein, 120 aa, Homo sapiens [sequence omitted]

SEQ ID NO: 847982 - protein, 836 aa, Homo sapiens; identical to SEQ ID NO: 847973

SEQ ID NO: 847983 - protein, 784 aa, Homo sapiens
LTLEDPRTVRQMPTVMQKEEEIEHHLQRAISAQQVYGEKRDNMVIPVPEAESNIAYYESIYPGEFKMPKQLIHIQPFSLDAEQPDYDLDSEDEVFVNKLKKKMDICPLQFEEMIDRLEKGSGQQPVSLQEAKLLLKEDDELIREVYEYWIKKRKNCRGPSLIPSVKQEKRDGSSTNDPYVAFRRRTEKMQTRKNRKNDEASYEKMLKLRRDLSRAVTILEMIKRREKSKRELLHLTLEIMEKRYNLGDYNGEIMSEVMAQRQPMKPTYAIPIIPITNSSQFKHQEAMDVKEFKVNKQDKADLIRPKRKYEKKPKVLPSSAAATPQQTSPAALPVFNAKDLNQYDFPSSDEEPLSQVLSGSSEAEEDNDPDGPFAFRRKAGCQYYAPHLDQTGNWPWTSPKDGGLGDVRYRYCLTTLTVPQRCIGFARRRVGRGGRVLLDRAHSDYDSVFHHLDLEMLSSPQHSPVNQFANTSETNTSDKSFSKDLSQILVNIKSCRWRHFRPRTPSLHDSDNDELSCRKLYRSINRTGTAQPGTQTCSTSTQSKSSSGSAHFAFTAEQYQQHQQQLALMQKQQLAQIQQQQANSNSSTNTSQGFVSKTLDSASAQFAASALVTSEQLMGFKMKDDVVLGIGVNGVLPASGVYKGLHLSSTTPTALVHTSPSTAGSALLQPSNITQTSSSHSALSHQVTAANSATTQVLIGNNIRLTVPSSVATVNSIAPINARHIPRTLSAVPSSALKLAAAANCQVSKVPSSSSVDSVPRENHESEKPALNNIADNTVAMEVT

SEQ ID NO: 847984 - protein, 836 aa, Homo sapiens; identical to SEQ ID NO: 847973

SEQ ID NO: 847985 - protein, 836 aa, Homo sapiens; identical to SEQ ID NO: 847973

SEQ ID NO: 847986 - protein, 272 aa, Homo sapiens
MSKLSFRARALDASKPLPVFRCEDLPDLHEYASINRAVPQMPTGMEKEEESEHHLQRAISAQQVYGEKRDNMVIPVPEAESNIAYYESIYPGEFKMPKQLIHIQPFSLDAEQPDYDLDSEDEVFVNKLKKKMDICPLQFEEMIDRLEKGSGQQPVSLQEAKLLLKEDDELIREVYEYWIKKRKNCRGPSLIPSVKQEKRDGSSTNDPYVAFRRRTEKMQTRKNRKNDEASYEKMLKLRRDLSRAVTILEMIKRREKSKRELLHLTLEIMEKR

SEQ ID NO: 847987 - protein, 356 aa, Homo sapiens
MSRPLLITFTPATDPSDLWKDGQQQPQPEKPESTLDGAAARAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAARAGQGAAVSYLLGRGAAWVGVCELSGRDAAQLAEEAGFPEVARMVRESHGETRSPENRSPTPSLQYCENCDTHFQDSNHRTSTAHLLSLSQGPQPPNLPLGVPISSPGFKLLLRGGWEPGMGLGPRGEGRANPIPTVLKRDQEGLGYRSAPQPRVTHFPAWDTRAVAGRERPPRVATLSWREERRREEKDRAWERDLRTYMNLEF

SEQ ID NO: 847988 - protein, 356 aa, Homo sapiens; identical to SEQ ID NO: 847987

SEQ ID NO: 847989 - protein, 356 aa, Homo sapiens; identical to SEQ ID NO: 847987

SEQ ID NO: 847990 - protein, 342 aa, Homo sapiens
MSRPLLITFTPATDPSDLWKDGQQQPQPEKPESTLDGAAARAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAARAGQGAAVSYLLGRGAAWVGVCELSGRDAAQLAEEAGFPEVARMVRESHGETRSPENRSPTPSLQYCENCDTHFQDSNHRTSTAHLLSLSQGPQPPNLPLGVPISRMGLGPRGEGRANPIPTVLKRDQEGLGYRSAPQPRVTHFPAWDTRAVAGRERPPRVATLSWREERRREEKDRAWERDLRTYMNLEF

SEQ ID NO: 847991 - protein, 209 aa, Homo sapiens [sequence omitted]

SEQ ID NO: 847992 - protein, 341 aa, Homo sapiens
VLWGYQAGMLLVTHCCVLSSGQGHAVSYLLGRGAAWVGVCELSGRDAAQLAEEAGFPEVARMVRESHGGEKEGGRRHGQGRSLEAEDKMTHRILRAAQEGDLPELRRLLEPHEAGGAGGNINARDAFWWTPLMCAARAGQGAAVSYLLGRGAAWVGVCELSGRDAAQLAEEAGFPEVARMVRESHGETRSPENRSPTPSLQYCENCDTHFQDSNHRTSTAHLLSLSQGPQPPNLPLGVPISSPGFKLLLRGGWEPGMGLGPRGEGRANPIPTVLKRDQEGLGYRSAPQPRVTHFPAWDTRAVAGRERPPRVATLSWREERRREEKDRAWERDLRTYMNLEF

SEQ ID NO: 847993 - protein, 129 aa, Homo sapiens
MSRPLLITFTPATDPSDLWKDGQQQPQPEKPESTLDGAAARAFYEALIGDESSAPDSQRSQTEPARERKRKKRRIMKAPAAEAVAEGASGRHGQGRSLEAEDKMTHRILRAAQEGDLPELRRTGLGSGI

SEQ ID NO: 847994 - protein, 108 aa, Homo sapiens
INHLWFIHFSGSYFEEAKQKPGSHMQVPPESEGAASPGGMIRSPPCQSGFTFRSQTLLGVPHLFFQPPWTKNCPASCKSHFPQEEFPDYSQFTDFTNISPYTMCQEYR

SEQ ID NO: 847995 - protein, 356 aa, Homo sapiens; identical to SEQ ID NO: 847987

SEQ ID NO: 847996 - protein, 356 aa, Homo sapiens; identical to SEQ ID NO: 847987

SEQ ID NO: 847997 - protein, 356 aa, Homo sapiens; identical to SEQ ID NO: 847987

SEQ ID NO: 847998 - protein, 340 aa, Homo sapiens
MSRPLLITFTPATDPKSTLDGAAARAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAARAGQGAAVSYLLGRGAAWVGVCELSGRDAAQLAEEAGFPEVARMVRESHGETRSPENRSPTPSLQYCENCDTHFQDSNHRTSTAHLLSLSQGPQPPNLPLGVPISSPGFKLLLRGGWEPGMGLGPRGEGRANPIPTVLKRDQEGLGYRSAPQPRVTHFPAWDTRAVAGRERPPRVATLSWREERRREEKDRAWERDLRTYMNLEF

SEQ ID NO: 847999 - protein, 209 aa, Homo sapiens [sequence omitted]

SEQ ID NO: 848000 - protein, 2040 aa, Homo sapiens
AGVLEDPSKRIRTDLQKVSDLSAPFSQSAGVDQKELSFSPSLLKIFCQLFSIHVDAINIMVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVNKSDDTAEHLLELGWFTMNNLLPNAVYKVVLRPQSSCQSGRQLALRLFSKVRPPVGGISVKEHFEVNVVPLTIQLTHQFFHRMMGFFFPGRSVEDDEVGDEEDKSKLVTTGIPVVKPRQLIATDDAVPLGPGKGVAQGLTRSSGVRRSFRKSPEVPNMPLMIEKWESLEVLFGVAWDFFGFL

SEQ ID NO: 848001 - protein, 2114 aa, Homo sapiens
AGVLEDPSKRIRTDLQKVSDLSAPFSQSAGVDQKELSFSPSLLKIFCQLFSIHVDAINIMVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVNKSDDTAEHLLELGWFTMNNLLPNAVYKVNVVPLTIQLTHQFFHRMMGFFFPGRSVEDDEVGDEEDKSKLVTTGIPVVKPRQLIATDDAVPLGPGKGVAQGLTRSSGVRRSFRKSPEHPVDDIDKMKERAAMNNSFIYIKIPQVPLCVSYKGEKNSVDWGDLNLVLPCLEYHNNTWTWLDFAMAVKRDSRKALVAQVIKEKLRLKSATGSEVRGKLETKSDLNMQQQEEEEKARLLIGLSVGDKNPGKKSIFGRRK

SEQ ID NO: 848002 - protein, 2238 aa, Homo sapiens
AGVLEDPSKRIRTDLQKVSDLSAPFSQSAGVDQKELSFSPSLLKIFCQLFSIHVDAINIMVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEGSWVGVLVLSENGRTRYSLCSCPIWSPESNLSVTGEWKEENILRENEPQLTSFDDSLLIPLPASDPLPVLPLALPVLSSDLSSGLFTDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVNKSDDTAEHLLELGWFTMNNLLPNAVYKVVLRPQSSCQSGRQLALRLFSKVRPPVGGISVKEHFEVNVVPLTIQLTHQFFHRMMGFFFPGRSVEDDEVGDEEDKSKLVTTGIPVVKPRQLIATDDAVPLGPGKGVAQGLTRSSGVRRSFRKSPEHPVDDIDKMKERAAMNNSFIYIKIPQVPLCVSYKGEKNSVDWGDLNLVLPCLEYHNNTWTWLDFAMAVKRDSRKALVAQVIKEKLRLKSATGSEVRGKLETKSDLNMQQQEEEEKARLLIGLSVGDKNPGKKSIFGRRK

SEQ ID NO: 848003 - protein, 2151 aa, Homo sapiens
AGVLEDPSKRIRTDLQKVSDLSAPFSQSAGVDQKELSFSPSLLKIFCQLFSIHVDAINIMVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVNKSDDTAEHLLELGWFTMNNLLPNAVYKVVLRPQSSCQSGRQLALRLFSKVRPPVGGISVKEHFEVNVVPLTIQLTHQFFHRMMGFFFPGRSVEDDEVGDEEDKSKLVTTGIPVVKPRQLIATDDAVPLGPGKGVAQGLTRSSGVRRSFRKSPEHPVDDIDKMKERAAMNNSFIYIKIPQVPLCVSYKGEKNSVDWGDLNLVLPCLEYHNNTWTWLDFAMAVKRDSRKALVAQVIKEKLRLKSATGSEVRGKLETKSDLNMQQQEEEEKARLLIGLSVGDKNPGKKSIFGRRK

SEQ ID NO: 848004 - protein, 2151 aa, Homo sapiens; identical to SEQ ID NO: 848003

SEQ ID NO: 848005 - protein, 2151 aa, Homo sapiens; identical to SEQ ID NO: 848003

SEQ ID NO: 848006 - protein, 1876 aa, Homo sapiens
AGVLEDPSKRIRTDLQKVSDLSAPFSQSAGVDQKELSFSPSLLKIFCQLFSIHVDAINIMVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVSGVYGHTKAAVLRDIDLA

SEQ ID NO: 848007 - protein, 1801 aa, Homo sapiens
AGVLEDPSKRIRTDLQKVSDLSAPFSQSAGVDQKELSFSPSLLKIFCQLFSIHVDAINIMVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKD

SEQ ID NO: 848008 - protein, 1668 aa, Homo sapiens
AGVLEDPSKRIRTDLQKVSDLSAPFSQSAGVDQKELSFSPSLLKIFCQLFSIHVDAINIMVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEERWIP

SEQ ID NO: 848009 - protein, 1480 aa, Homo sapiens
AGVLEDPSKRIRTDLQKVSDLSAPFSQSAGVDQKELSFSPSLLKIFCQLFSIHVDAINIMVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGKLGEMRLFGFGFRTWIWAWTGVLKGLSHGASI

SEQ ID NO: 848010 - protein, 129 aa, Homo sapiens
GLFRGPLWMQVSVLSFSNTRETVEIDNLWISSKLLSHDLPHYVALCFGEVRIRTDLQKVSDLSAPFSQSAGVDQKELSFSPSLLKIFCQLFSIHVDAINIMVLKVDTSESLWHIQISRSRFLLDSDGKR

SEQ ID NO: 848011 - protein, 2151 aa, Homo sapiens; identical to SEQ ID NO: 848003

SEQ ID NO: 848012 - protein, 2101 aa, Homo sapiens
AGVLEDPSKRIRTDLQKVSDLSAPFSQSAGVDQKELSFSPSLLKIFCQLFSIHVDAINIMVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVNKSDDTAEHLLELGWFTMNNLLPNAVYKVVLRPQSSCQSGRQLALRLFSKVRPPVGGISVKEHFEVNVVPLTIQLTHQFFHRMMGFFFPGRSVEDDEVGDEEDKSKLVTTGIPVVKPRQLIATDDAVPLGPGKGVAQGLTRSSGVRRSFRKSPEHPVDDIDKMKERAAMNNSFIYIKIPQVPLCVSYKGEKNSVDWGDLNLVLPCLEYHNNTWTWLDFAMAVKRDSRKALVAQVSRQGSWLFG

SEQ ID NO: 848013 - protein, 1747 aa, Homo sapiens [sequence omitted]

SEQ ID NO: 848014 - protein, 2151 aa, Homo sapiens; identical to SEQ ID NO: 848003

SEQ ID NO: 848015 - protein, 2151 aa, Homo sapiens; identical to SEQ ID NO: 848003

SEQ ID NO: 848016 - protein, 2053 aa, Homo sapiens
AGVLEDPSKRIRTDLQKVSDLSAPFSQSAGVDQKELSFSPSLLKIFCQLFSIHVDAINIMVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVNKSDDTAEHLLELGWFTMNNLLPNAVYKVVLRPQSSCQSGRQLALRLFSKVRPPVGGISVKEHFEVNVVPLTIQLTHQFFHRMMGFFFPGRSVEDDEVGDEEDKSKLVTTGIPVVKPRQLIATDDAVPLGPGKGVAQGLTRSSGVRRSFRKSPEHPVDDIDKMKERAAMNNSFIYIKIPQVPLCVSYKSQAQCGE

SEQ ID NO: 848017 - protein, 265 aa, Homo sapiens
MEDPLPCTPWSGRQLALRLFSKVRPPVGGISVKEHFEVNVVPLTIQLTHQFFHRMMGFFFPGRSVEDDEVGDEEDKSKLVTTGIPVVKPRQLIATDDAVPLGPGKGVAQGLTRSSGVRRSFRKSPEHPVDDIDKMKERAAMNNSFIYIKIPQVPLCVSYKGEKNSVDWGDLNLVLPCLEYHNNTWTWLDFAMAVKRDSRKALVAQVIKEKLRLKSATGSEVRGKLETKSDLNMQQQEEEEKARLLIGLSVGDKNPGKKSIFGRRK

SEQ ID NO: 848018 - protein, 219 aa, Homo sapiens
MGMSSLKLLKYVLFFFNLLFWICGCCILGFGIYLLIHNNFGVLFHNLPSLTLGNVFVIVGSIIMVVAFLGCMGSIKENKCLLMSFFILLLIILLAEVTLAILLFVYEQKLNEYVAKGLTDSIHRYHSDNSTKAAWDSIQSFLQCCGINGTSDWTSGPPASCPSDRKVEGCYAKARLWFHSNFLYIGIITICVCVIEVLGMSFALTLNCQIDKTSQTIGL

SEQ ID NO: 848019 - protein, 164 aa, Homo sapiens
MGMSSLKLLKYVLFFFNLLFWICGCCILGFGIYLLIHNNFGVLFHNLPSLTLGNVFVIVGSIIMVVAFLGCMGSIKENKCLLMSFFILLLIILLAEVTLAILLFVYEQKLNEYVAKGLTDSIHRYHSDNSTKAAWDSIQSFVLGMSFALTLNCQIDKTSQTIGL

SEQ ID NO: 848020 - protein, 219 aa, Homo sapiens; identical to SEQ ID NO: 848018

SEQ ID NO: 848021 - protein, 107 aa, Homo sapiens
MGMSSLKLLKYVLFFFNLLFWICGCCILGFGIYLLIHNNFGVLFHNLPSLTLGNVFVIVGSIIMVVAFLGCMGSIKENKCLLMSVLGMSFALTLNCQIDKTSQTIGL

SEQ ID NO: 848022 - protein, 205 aa, Homo sapiens
MGMSSLKLLKYVLFFFNLLFWICGCCILGFGIYLLIHNNFGVLFHNLPSLTLGNVFVIVGSIIMVVAFLGCMGSIKENKCLLMSFFILLLIILLAEVTLAILLFVYEQKLNEYVAKGLTDSIHRYHSDNSTKAAWDSIQSFLQCCGINGTSDWTSGPPASCPSDRKVEGCYAKARLWFHSNFLYIGIITICVCVIEGKSLTTGLL

SEQ ID NO: 848023 - protein, 161 aa, Homo sapiens
MGMSSLKLLKYVLFFFNLLFWICGCCILGFGIYLLIHNNFGVLFHNLPSLTLGNVFVIVGSIIMVVAFLGCMGSIKAEVTLAILLFVYEQKLNEYVAKGLTDSIHRYHSDNSTKAAWDSIQSFLQCCGINGTSDWTSGPPASCPSDRKVELLSKPDCGSHF

SEQ ID NO: 848024 - protein, 219 aa, Homo sapiens; identical to SEQ ID NO: 848018

SEQ ID NO: 848025 - protein, 191 aa, Homo sapiens
MGMSSLKLLKYVLFFFNLLFWICGCCILGFGIYLLIHNNFGVLFHNLPSLTLGNVFVIVGSIIMVVAFLGCMGSIKENKCLLMSFFILLLIILLAEVTLAILLFVYEQKLNEYVAKGLTDSIHRYHSDNSTKAAWDSIQSFLQCCGINGTSDWTSGPPASCPSDRKVEVLGMSFALTLNCQIDKTSQTIGL

SEQ ID NO: 848026 - protein, 219 aa, Homo sapiens; identical to SEQ ID NO: 848018

SEQ ID NO: 848027 - protein, 219 aa, Homo sapiens; identical to SEQ ID NO: 848018

SEQ ID NO: 848028 - protein, 107 aa, Homo sapiens; identical to SEQ ID NO: 848021

SEQ ID NO: 848029 - protein, 219 aa, Homo sapiens; identical to SEQ ID NO: 848018

SEQ ID NO: 848030 - protein, 216 aa, Homo sapiens
MGMSSLKLLKYVLFFFNLLFWICGCCILGFGIYLLIHNNFGVLFHNLPSLTLGNVFVIVGSIIMVVAFLGCMGSIKENKCLLMSFFILLLIILLAEVTLAILLFVYEQKLNEYVAKGLTDSIHRYHSDNSTKAAWDSIQSFLQCCGINGTSDWTSGPPASCPSDRKVEGCYAKARLWFHSNFLYIGIITICVCVIERVGEFLLTDPELADCKTGRP

SEQ ID NO: 848031 - protein, 279 aa, Homo sapiens
LGHSLEPLLLGSPQGPWAEGRSIQLELTTGGRGIMEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIRRNPPMGGNVVIFDTVITNQEEPYQNHSGRFVCTVPGYYYFTFQVLSQWEICLSIVSSSRGQVRRSLGFCDTTNKGLFQVVSGGMVLQLQQGDQVWVEKDPKKGHIYQGSEADSVFSGFLIFPSA

SEQ ID NO: 848032 - protein, 279 aa, Homo sapiens; identical to SEQ ID NO: 848031

SEQ ID NO: 848033 - protein, 288 aa, Homo sapiens
LGHSLEPLLLGSPQGPWAEGRSIQLELTTGGRGIMEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIRRNPPMGGNVVIFDTVITNQEEPYQNHSGRFVCTVPGYYYFTFQVLSQWEICLSIVSSSRGQVRRSLGFCDTTNKGLFQVVSGGMVLQLQQGDQVWVEKDPKKGHIYQGSEADSVFSGFLIFPSACLRWDPLDH

SEQ ID NO: 848034 - protein, 98 aa, Homo sapiens
LGHSLEPLLLGSPQGPWAEGRSIQLELTTGGRGIMEGPRGWLVLCVLAISLASMVTEDLCRAPDGKKGGVEKDPKKGHIYQGSEADSVFSGFLIFPSA

SEQ ID NO: 848035 - protein, 117 aa, Homo sapiens
LGHSLEPLLLGSPQGPWAEGRSIQLELTTGGRGIMEGPRGWLVLCVLAISLASMVTEDLCRAPDGKKGEAGRPGRRGRPGLKGEQGEPVSQGRTPSPTHLSGFHAPPVKWGRYCFSC

SEQ ID NO: 848036 - protein, 245 aa, Homo sapiens
MEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIRRNPPMGGNVVIFDTVITNQEEPYQNHSGRFVCTVPGYYYFTFQVLSQWEICLSIVSSSRGQVRRSLGFCDTTNKGLFQVVSGGMVLQLQQGDQVWVEKDPKKGHIYQGSEADSVFSGFLIFPSA

SEQ ID NO: 848037 - protein, 286 aa, Homo sapiens
LGHSLEPLLLGSPQGPWAEGRSIQLELTTGGRGIMEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIRRNPPMGGNVVIFDTVITNQEEPYQNHSGRFVCTVPGYYYFTFQVLSQWEICLSIVSSSRGQVRRSLGFCDTTNKGLFQVVSGGMVLQLQQGDQVWVEKDPKKGHIYQGSEADSVINASLIVPASDADPLEH

SEQ ID NO: 848038 - protein, 243 aa, Homo sapiens
LGHSLEPLLLGSPQGPWAEGRSIQLELTTGGRGIMEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIRRNPPMGGNVVIFDTVITNQEEPYQNHSGRFVCTVPGYYYFTFQTPCPLAWERGSRSEDISVPGQKPPTCSSFSGMDVGPSSLPHLGLK

SEQ ID NO: 848039 - protein, 54 aa, Homo sapiens
MESFYEGEDFSETLTRAKLEELNRDLFRSTMKPVQKGWEDTDWKRSDMDAGRGV

SEQ ID NO: 848040 - protein, 118 aa, Homo sapiens
MKNIHPIYNIKSLMIKRELAKDSELRSQSWERFLPQFKHKNVNKRKEPKKKTVKKEYTPFPPPQPESQIDKELASGEYFLKANQKKRQKMEAIKAKQAEAISKRQEERNKAFIPLVSY

SEQ ID NO: 848041 - protein, 399 aa, Homo sapiens
PVGFKNSFISGATGSSLQMASPSLERPEKGAGKSEFRNQKPKPENQDESELLTVPDGWKEPAFSKEDNPRGLLEESSFATLFPKYREAYLKECWPLVQKALNEHHVNATLDLIEGSMTVCTTKKTFDPYIIIRARDLIKLLARSVSFEQAVRILQDDVACDIIKIGSLVRNKERFVKRRQRLIGPKGSTLKALELLTNCYIMVQGNTVSAIGPFSGLKEVRKVVLDTMKNIHPIYNIKSLMIKRELAKDSELRSQSWERFLPQFKHKNVNKRKEPKKKTVKKEYTPFPPPQPESQIDKELASGEYFLKANQKKRQKMEAIKAKQAEAISKRQEERNKAFIPPKEKPIVKPKEASTETKIDVASIKEKVKKAKNKKLGALTAEEIALKMEADEKKKKKKK

SEQ ID NO: 848042 - protein, 399 aa, Homo sapiens; identical to SEQ ID NO: 848041

SEQ ID NO: 848043 - protein, 399 aa, Homo sapiens; identical to SEQ ID NO: 848041

SEQ ID NO: 848044 - protein, 399 aa, Homo sapiens; identical to SEQ ID NO: 848041

SEQ ID NO: 848045 - protein, 399 aa, Homo sapiens; identical to SEQ ID NO: 848041

SEQ ID NO: 848046 - protein, 399 aa, Homo sapiens; identical to SEQ ID NO: 848041

SEQ ID NO: 848047 - protein, 702 aa, Homo sapiens
MLLFFTKSDISEIKNDWTGRKMVRKLCKSTTVCKDKYSTLNGKEESKQFNDIEFYNFRPARDLIKHEQWNTFFQTKFRAVELGLTLSFLYSKHPTLARLLWVQFVTNMDTKVPQALHSLIEVSPSHHGKKTYWDGSGLCLEQEQEINSWSLTNISKSQSRILLGCLVKHPWKFNCLQLLHFFIKCCLANKKCHVAALFYFHFLEIDPHCVTQAGVQWYNLCSLQPPPPGLRSLSCLSLLSSWGYGRPPPHPASFCIFSRGGFCHVGQAGHGGMVISATWEAEAGGSPEPVDGGCSELRSHHCTLAWVTEQDSVSKKKKKKKNENRILFVWMTCLLIFDLAEISKSSGILVYSFCQFFLLLLFDQLELNKKNVIFTFKFLFKCIPRTVSHWFNCYLMPVSLKIAVKIKHGFIVNSVESLHVTIMLFYWCIVPFTHHRDCPNTCHYWGRHCRWLLSYMAKLGNSLCKAEEGCPLEVFRFFKIAIYYESLTEIQKNSGVKYKGPEELVIEVKTGRQKWKAANICIVHSMYLCLCTCFNLQSHLIVTALRGSYSCFTDETKDVRDTFNHNLYTSESEETWIYSRAVLPLFTYPLAYMITAIQKTVHLRKAMVTHIQYSQWSALHNFHWIGAIWLVPSKKIINNGMGEFLKYKLFSHTRCDMNKELLISEHYHVLVFVLNNLEGNNLHKNPMRKLLLSIYTHYIARG

SEQ ID NO: 848048 - protein, 718 aa, Homo sapiens
MEEFSEYIDTLILSALWLHVTFLHKSDISEIKNDWTGRKMVRKLCKSTTVCKDKYSTLNGKEESKQFNDIEFYNFRPARDLIKHEQWNTFFQTKFRAVELGRLCPSSILSTLLSPAALSSVCYKYGHESTTGFAQLNGSFPFTPWSKNILGWKGLCLEQEQEINSWSLTNISKSQSRILLGCLVKHPWKFNCLQLLHFFIKCCLANKKCHVAALFYFHFLEIDPHCVTQAGVQWYNLCSLQPPPPGLRSLSCLSLLSSWGYGRPPPHPASFCIFSRGGFCHVGQAGHGGMVISATWEAEAGGSPEPVDGGCSELRSHHCTLAWVTEQDSVSKKKKKKKNENRILFVWMTCYTYFVILLKEANLRNLSLQFLTVFFVVVFDQLELNKKNVIFTFKFLFKCIPRTVSHWFNCYLMPVSLKIAVKIKHGFIVNSVESLHVTIMLFYWCIVPFTHHRDCPNTCHYWGRHCRWLLSYMAKLGNSLCKAEEGCPLEVFRFFKIAIYYESLTKSRRIVEEVQRSRELVIEVKTGRQKWKAANICIVHSMYLCLCTCFNLQSHLIVTALRGSYSCFTDETKDVRDTFNHNLYTSEQRKPGFNSRAVLPLFTYPLAYMITAIQKTVHLRKAMVTHIQYSQLVSLHNFHWIGAIWLVPSKKIINNGMGEFLKYKLFSHTRCDMNKELLISEHYHVLVFVLNNLEGNNLHKNPMRKLLLSIYTHYIARG

SEQ ID NO: 848049 - protein, 69 aa, Homo sapiens
SAPPNNLPLNIGESRPRVNRPSGSSLQMASPSLERPEKGAGKSEFRNQKPKPENQGDVMWEPKPGVCVR

SEQ ID NO: 848050 - protein, 220 aa, Homo sapiens
MASPSLERPEKGAGKSEFRNQKPKPENQDESELLTVPDGWKEPAFSKEDNPRGLLEESSFATLFPKYREAYLKECWPLVQKALNEHHVNATLDLIEGSMTVCTTKKTFDPYIIIRARDLIKLLARSVSFEQAVRILQDDVACDIIKIGSLVRNKERFVKRRQRLIGPKGSTLKALELLTNCYIMVQGNTVSAIGPFSGLKEVRTMYYLRFIFSREQIIWL

SEQ ID NO: 848051 - protein, 399 aa, Homo sapiens; identical to SEQ ID NO: 848041

SEQ ID NO: 848052 - protein, 399 aa, Homo sapiens; identical to SEQ ID NO: 848041

SEQ ID NO: 848053 - protein, 399 aa, Homo sapiens; identical to SEQ ID NO: 848041

SEQ ID NO: 848054 - protein, 399 aa, Homo sapiens; identical to SEQ ID NO: 848041

SEQ ID NO: 848055 - protein, 364 aa, Homo sapiens
PVGFKNSFISGATGSSLQMASPSLERPEKGAGKSEFRNQKPKPENQDESELLTVPDGWKEPAFSKEDNPRGLLEESSFATLFPKYREAYLKECWPLVQKALNEHHVNATLDLIEGSMTVCTTKKTFDPYIIIRARDLIKLLARSVSFEQAVRILQDDVACDIIKIGSLVRNKERFVKRRQRLIGPKGSTLKALELLTNCYIMVQGNTVSAIGPFSGLKEVRKVVLDTMKNIHPIYNIKSLMIKRELAKDSELRSQSWERFLPQFKHKNVNKRKEPKKKTVKKEYTPFPPPQPESQIDKELASGEYFLKANQKKRQKMEAIKAKQAEAISKRQEERNKAFIPPKEKPIVKPKEGNAFYDVKVFIN

SEQ ID NO: 848056 - protein, 177 aa, Homo sapiens
MASPSLERPEKGAGKSEFRNQKPKPENQDESELLTVPDGWKEPAFSKEDNPRGLLEESSFATLFPKYREAYLKECWPLVQKALNEHHVNATLDLIEGSMTVCTTKKTFDPYIIIRARDLIKLLARSVSFEQAVRILQDDVACDIIKIGSLVRNKERFVKRRQRLIGPKGSTLKVFFN

SEQ ID NO: 848057 - protein, 924 aa, Homo sapiens
MTTEQRRSLQAFQDYIRKTLDPTYILSYMAPWFREEEVQYIQAEKNNKGPMEAATLFLKFLLELQEEGWFRGFLDALDHAGYSGLYEAIESWDFKKIEKLEEYRLLLKRLQPEFKTRIIPTDIISDLSECLINQECEEILQSSTKGMMAGAEKLVECLLRSDKENWPKTLKLALEKERNKFSELWIVEKGIKDVETEDLEDKMETSDIQIFYQEDPECQNLSENSCPPSEVSDTNLYSPFKPRNYQLELALPAMKGKNTIICAPTGCGKTFVSLLICEHHLKKFPQGQKGKVVFFANQIPVYEQQKSVFSKYFERHGYRVTGISGATAENVPVEQIVENNDIIILTPQILVNNLKKGTIPSLSIFTLMIFDECHNTSKQHPYNMIMFNYLDQKLGGSSGPLPQVIGLTASVGVGDAKNTDEALDYICKLCASLDASVIATVKHNLEELEQVVYKPQKFFRKVESRISDKFKYIIAQLMRDTESLAKRICKDLENLSQIQNREFGTQKYEQWIVTVQKACMVFQMPDKDEESRICKALFLYTSHLRKYNDALIISEHARMKDALDYLKDFFSNVRAAGFDEIEQDLTQRFEEKLQELESVSRDPSNENPKLEDLCFILQEEYHLNPETITILFVKTRALVDALKNWIEGNPKLSFLKPGILTGRGKTNQNTGMTLPAQKCILDAFKASGDHNILIATSVADEGIDIAQCNLVILYEYVGNVIKMIQTRGRGRARGSKCFLLTSNAGVIEKEQINMYKEKMMNDSILRLQTWDEAVFREKILHIQTHEKFIRDSQEKPKPVPDKENKKLLCRKCKALACYTADVRVIEECHYTVLGDAFKECFVSRPHPKPKQFSSFEKRAKIFCARQNCSHDWGIHVKYKTFEIPVIKIESFVVEDIATGVQTLYSKWKDFHFEKIPFDPAEMSK

SEQ ID NO: 848058 - protein, 1028 aa, Homo sapiens
MTTEQRRSLQAFQDYIRKTLDPTYILSYMAPWFREEEVQYIQAEKNNKGPMEAATLFLKFLLELQEEGWFRGFLDALDHAGYSGLYEAIESWDFKKIEKLEEYRLLLKRLQPEFKTRIIPTDIISDLSECLINQECEEILQSSTKGMMAGAEKLVECLLRSDKENWPKTLKLALEKERNKFSELWIVEKGIKDVETEDLEDKMETSDIQIFYQEDPECQNLSENSCPPSEVSDTNLYSPFKPRNYQLELALPAMKGKNTIICAPTGCGKTFVSLLICEHHLKKFPQGQKGKVVFFANQIPVYEQQKSVFSKYFERHGYRVTGISGATAENVPVEQIVENNDIIILTPQILVNNLKKGTIPSLSIFTLMIFDECHNTSKQHPYNMIMFNYLDQKLGGSSGPLPQVSPKSDECFRRAIIFLTPIFLLFMATLKMSFSGPKSILYNSLRILFPLFICSLSKYALCASMCHTLCVSKNKKTPYPSRKELYEGLWKHCTISQTSNDFECSLQVIGLTASVGVGDAKNTDEALDYICKLCASLDASVIATVKHNLEELEQVVYKPQKFFRKVESRISDKFKYIIAQLMRDTESLAKRICKDLENLSQIQNREFGTQKYEQWIVTVQKACMVFQMPDKDEESRICKALFLYTSHLRKYNDALIISEHARMKDALDYLKDFFSNVRAAGFDEIEQDLTQRFEEKLQELESVSRDPSNENPKLEDLCFILQEEYHLNPETITILFVKTRALVDALKNWIEGNPKLSFLKPGILTGRGKTNQNTGMTLPAQKCILDAFKASGDHNILIATSVADEGIDIAQCNLVILYEYVGNVIKMIQTRGRGRARGSKCFLLTSNAGVIEKEQINMYKEKMMNDSILRLQTWDEAVFREKILHIQTHEKFIRDSQEKPKPVPDKENKKLLCRKCKALACYTADVRVIEECHYTVLGDAFKECFVSRPHPKPKQFSSFEKRAKIFCARQNCSHDWGIHVKYKTFEIPVIKIESFVVEDIATGVQTLYSKWKDFHFEKIPFDPAEMSK

SEQ ID NO: 848059 - protein, 924 aa, Homo sapiens; identical to SEQ ID NO: 848057

SEQ ID NO: 848060 - protein, 416 aa, Homo sapiens
MTTEQRRSLQAFQDYIRKTLDPTYILSYMAPWFREEEVQYIQAEKNNKGPMEAATLFLKFLLELQEEGWFRGFLDALDHAGYSGLYEAIESWDFKKIEKLEEYRLLLKRLQPEFKTRIIPTDIISDLSECLINQECEEILQSSTKGMMAGAEKLVECLLRSDKENWPKTLKLALEKERNKFSELWIVEKGIKDVETEDLEDKMETSDIQIFYQEDPECQNLSENSCPPSEVSDTNLYSPFKPRNYQLELALPAMKGKNTIICAPTGCGKTFVSLLICEHHLKKFPQGQKGKVVFFANQIPVYEQQKSVFSKYFERHGYRVTGISGATAENVPVEQIVENNDIIILTPQILVNNLKKGTIPSLSIFTLMIFDECHNTSKQHPYNMIMFNYLDQKLGGSSGPLPQSLGCCLVGVGDNI

SEQ ID NO: 848061 - protein, 924 aa, Homo sapiens; identical to SEQ ID NO: 848057

SEQ ID NO: 848062 - protein, 876 aa, Homo sapiens
MTTEQRRSLQAFQDYIRKTLDPTYILSYMAPWFREEEVQYIQAEKNNKGPMEAATLFLKFLLELQEEGWFRGFLDALDHAGYSGLYEAIESWDFKKIEKLEEYRLLLKRLQPEFKTRIIPTDIISDLSECLINQECEEILQVIKDVETEDLEDKMETSDIQIFYQEDPECQNLSENSCPPSEVSDTNLYSPFKPRNYQLELALPAMKGKNTIICAPTGCGKTFVSLLICEHHLKKFPQGQKGKVVFFANQIPVYEQQKSVFSKYFERHGYRVTGISGATAENVPVEQIVENNDIIILTPQILVNNLKKGTIPSLSIFTLMIFDECHNTSKQHPYNMIMFNYLDQKLGGSSGPLPQVIGLTASVGVGDAKNTDEALDYICKLCASLDASVIATVKHNLEELEQVVYKPQKFFRKVESRISDKFKYIIAQLMRDTESLAKRICKDLENLSQIQNREFGTQKYEQWIVTVQKACMVFQMPDKDEESRICKALFLYTSHLRKYNDALIISEHARMKDALDYLKDFFSNVRAAGFDEIEQDLTQRFEEKLQELESVSRDPSNENPKLEDLCFILQEEYHLNPETITILFVKTRALVDALKNWIEGNPKLSFLKPGILTGRGKTNQNTGMTLPAQKCILDAFKASGDHNILIATSVADEGIDIAQCNLVILYEYVGNVIKMIQTRGRGRARGSKCFLLTSNAGVIEKEQINMYKEKMMNDSILRLQTWDEAVFREKILHIQTHEKFIRDSQEKPKPVPDKENKKLLCRKCKALACYTADVRVIEECHYTVLGDAFKECFVSRPHPKPKQFSSFEKRAKIFCARQNCSHDWGIHVKYKTFEIPVIKIESFVVEDIATGVQTLYSKWKDFHFEKIPFDPAEMSK

SEQ ID NO: 848063 - protein, 202 aa, Homo sapiens [sequence omitted]

SEQ ID NO: 848064 - protein, 648 aa, Homo sapiens
MTTEQRRSLQAFQDYIRKTLDPTYILSYMAPWFREEEVQYIQAEKNNKGPMEAATLFLKFLLELQEEGWFRGFLDALDHAGYSGLYEAIESWDFKKIEKLEEYRLLLKRLQPEFKTRIIPTDIISDLSECLINQECEEILQSSTKGMMAGAEKLVECLLRSDKENWPKTLKLALEKERNKFSELWIVEKGIKDVETEDLEDKMETSDIQIFYQEDPECQNLSENSCPPSEVSDTNLYSPFKPRNYQLELALPAMKGKNTIICAPTGCGKTFVSLLICEHHLKKFPQGQKGKVVFFANQIPVYEQQKSVFSKYFERHGYRVTGISGATAENVPVEQIVENNDIIILTPQILVNNLKKGTIPSLSIFTLMIFDECHNTSKQHPYNMIMFNYLDQKLGGSSGPLPQVIGLTASVGVGDAKNTDEALDYICKLCASLDASVIATVKHNLEELEQVVYKPQKFFRKVESRISDKFKYIIAQLMRDTESLAKRICKDLENLSQIQNREFGTQKYEQWIVTVQKACMVFQMPDKDEESRICKALFLYTSHLRKYNDALIISEHARMKDALDYLKDFFSNVRAAGFDEIEQDLTQRFEEKLQELESVSRDPSNENPKLEDLCFILQEEYHLNPETITILFVKTRALVDVSFFSPCR

SEQ ID NO: 848065 - protein, 1070 aa, Homo sapiens
AAGEAPAAGRKMMKFRFRRQGADPQREKLKQELFAFNKTVEHGFPNQPSALAFDPELRIMAIGTRSGAVKIYGAPGVEFTGLHRDAATVTQMHFLTGQGRLLSLLDDSSLHLWEIVHHNGCAHLEEALSFQLPSRPGFDGASAPLSLTRVTVVLLVAAGDIAALGTEGSSVFFLDVTTLTLLEGQTLAPGEVLRSVPDDYRCGKALGPVESLQGHLRDPTKILIGYSRGLLVIWNQASQCVDHIFLGNQQLESLCWGRDSSTVVSSHSDGSYAVWSVDAGSFPTLQPTVATTPYGPFPCKAINKILWRNCESGGHFIIFSGGMPRASYGDRHCVSVLRAETLVTLDFTSRIIDFFTVHSTRPEDEFDDPQALAVLLEEELVVLDLQTPGWPAVPAPYLAPLHSSAITCSAHVASVPAKLWARIVSAGEQQSPQPVSSALSWPITGGRNLAQEPSQRGLLLTGHEDGTVRFWDASGVALRPLYKLSTAGLFQTDCEHADSLAQAAEDDWPPFRKVGCFDPYSDDPRLGVQKVALCKYTAQMVVAGTAGQVLVLELSDVPVEQAVSVAIIDLLQDREGFTWKGHERLSPRTGPLPWPAGFQPRVLVQCLPPAAVTAVTLHTEWSLVAFGTSHGFGLFEPCLARCTLHPNDSLAMEGPLSRVKSLKKSLRQSFRRIRKSRVSGKKRAANASSKLQEANAQLAEQACPHDVEMTPVQRRIEPRSADDSLSGVVRCLYFADTFLRDGAHHGPTMWAGTNSGSVFAYALEVPAAAVGGEKRPEQAVEAVLGKEVQLMHRAPVVAIAVLDGRGRPLPEPYEASRDLAQAPDMQGGHAVLIASEEQFKVFTLPKVSAKTKFKLTAHEGCRVRKVALATFASVACEDYAETCLACLTNLGDVHVFSVPGLRPQVHYSCIRKEDISGIASCVFTRHGQGFYLISPSEFERFSLSARNITEPLCSLDINWPRDATQASYRIRESPKLSQANGTPSILLAPQSLDGSPDPAHSMGPDTPEPPEAALSPMSIDSATSADTTLDTTGDVTVEDVKDFLGSSEESEKNLRNLAEDEAHACAILIK

SEQ ID NO: 848066 - protein, 1075 aa, Homo sapiens
AAGEAPAAGRKMMKFRFRRQGADPQREKLKQELFAFNKTVEHGFPNQPSALAFDPELRIMAIGTRSGAVKIYGAPGVEFTGLHRDAATVTQMHFLTGQGRLLSLLDDSSLHLWEIVHHNGCAHLEEALSFQLPSRPGFDGASAPLSLTRVTVVLLVAAGDIAALGTEGSSVFFLDVTTLTLLEGQTLAPGEVLRSVPDDYRCGKALGPVESLQGHLRDPTKILIGYSRGLLVIWNQASQCVDHIFLGNQQLESLCWGRDSSTVVSSHSDGSYAVWSVDAGSFPTLQPTVATTPYGPFPCKAINKILWRNCESGGHFIIFSGGMPRASYGDRHCVSVLRAETLVTLDFTSRIIDFFTVHSTRPEDEFDDPQALAVLLEEELVVLDLQTPGWPAVPAPYLAPLHSSAITCSAHVASVPAKLWARIVSAGEQQSPQPVSSALSWPITGGRNLAQEPSQRGLLLTGHEDGTVRFWDASGVALRPLYKLSTAGLFQTDCEHADSLAQAAEDDWPPFRKVGCFDPYSDDPRLGVQKVALCKYTAQMVVAGTAGQVLVLELSDVPVEQAVSVAIIDLLQDREGFTWKGHERLSPRTGPLPWPAGFQPRVLVQCLPPAAVTAVTLHTEWSLVAFGTSHGFGLFDYQRKSPVLARCTLHPNDSLAMEGPLSRVKSLKKSLRQSFRRIRKSRVSGKKRAANASSKLQEANAQLAEQACPHDVEMTPVQRRIEPRSADDSLSGVVRCLYFADTFLRDGAHHGPTMWAGTNSGSVFAYALEVPAAAVGGEKRPEQAVEAVLGKEVQLMHRAPVVAIAVLDGRGRPLPEPYEASRDLAQAPDMQGGHAVLIASEEQFKVFTLPKVSAKTKFKLTAHEGCRVRKVALATFASVACEDYAETCLACLTNLGDVHVFSVPGLRPQVHYSCIRKEDISGIASCVFTRHGQGFYLISPSEFERFSLSARNITEPLCSLDINWPRDATQASYRIRESPKLSQANGTPSILLAPQSLDGSPDPAHSMGPDTPEPPEAALSPMSIDSATSADTTLDTTGDVTVEDVKDFLGSSEESEKNLRNLAEDEAHACAILIK

SEQ ID NO: 848067 - protein, 1096 aa, Homo sapiens
AAGEAPAAGRKMMKFRFRRQGADPQREKLKQELFAFNKTVEHGFPNQPSALAFDPELRIMAIGTRSGAVKIYGAPGVEFTGLHRDAATVTQMHFLTGQGRLLSLLDDSSLHLWEIVHHNGCAHLEEALSFQLPSRPGFDGASAPLSLTRVTVVLLVAAGDIAALGTEGSSVFFLDVTTLTLLEGQTLAPGEVLRSVPDDYRCGKALGPVESLQGHLRDPTKILIGYSRGLLVIWNQASQCVDHIFLGNQQLESLCWGRDSSTVVSSHSDGSYAVWSVDAGSFPTLQPTVATTPYGPFPCKAINKILWRNCESGGHFIIFSGGMPRASYGDRHCVSVLRAETLVTLDFTSRIIDFFTVHSTRPEDEFDDPQALAVLLEEELVVLDLQTPGWPAVPAPYLAPLHSSAITCSAHVASVPAKLWARIVSAGEQQSPQPVSSALSWPITGGRNLAQEPSQRGLLLTGHEDGTVRFWDASGVALRPLYKLSTAGLFQTDCEHADSLAQAAEDDWPPFRKVGCFDPYSDDPRLGVQKVALCKYTAQMVVAGTAGQVLVLELSDVPVEQAVSVAIIDLLQDREGFTWKGHERLSPRTGPLPWPAGFQPRVLVQCLPPAAVTAVTLHTEWSLVAFGTSHGFGLFDYQRKSPVLARCTLHPNDSLAMEGPLSRVKSLKKSLRQSFRRIRKSRVSGKKRAANASSKLQEANAQLAEQACPHDVEMTPVQRRIEPRSADDSLSGVVRCLYFADTFLRDGAHHGPTMWAGTNSGSVFAYALEVPAAAVGGEKRPEQAVEAVLGKEVQLMHRAPVVAIAVLDGRGRPLPEPYEASRDLAQAPDMQGGHAVLIASEEQFKVFTLPKVSAKTKFKLTAHEGCRVRKVALATFASVACEDYAETCLACLTNLGDVHVFSVPGLRPQVHYSCIRKEDISGIASCVFTRHGQGFYLISPSEFERFSLSARNITEPLCSLDINWPRDATQASYRIRESPKLSQANGTPSILLAPQSLDGSPDPAHSMGPDTPEPPEAALSPMSIDSATSADTTLDTTGDVTVEDVKDFLGKARTIPTSTCPARSWSAGSLAPAWPLNIEPRLLTCRLHWDLLSCPA

SEQ ID NO: 848068 - protein, 838 aa, Homo sapiens
MPACLPAPACPQQLESLCWGRDSSTVVSSHSDGSYAVWSVDAGSFPTLQPTVATTPYGPFPCKAINKILWRNCESGGHFIIFSGGMPRASYGDRHCVSVLRAETLVTLDFTSRIIDFFTVHSTRPEDEFDDPQALAVLLEEELVVLDLQTPGWPAVPAPYLAPLHSSAITCSAHVASVPAKLWARIVSAGEQQSPQPVSSALSWPITGGRNLAQEPSQRGLLLTGHEDGTVRFWDASGVALRPLYKLSTAGLFQTDCEHADSLAQAAEDDWPPFRKVGCFDPYSDDPRLGVQKVALCKYTAQMVVAGTAGQVLVLELSDVPVEQAVSVAIIDLLQDREGFTWKGHERLSPRTGPLPWPAGFQPRVLVQCLPPAAVTAVTLHTEWSLVAFGTSHGFGLFDYQRKSPVLARCTLHPNDSLAMEGPLSRVKSLKKSLRQSFRRIRKSRVSGKKRAANASSKLQEANAQLAEQACPHDVEMTPVQRRIEPRSADDSLSGVVRCLYFADTFLRDGAHHGPTMWAGTNSGSVFAYALEVPAAAVGGEKRPEQAVEAVLGKEVQLMHRAPVVAIAVLDGRGRPLPEPYEASRDLAQAPDMQGGHAVLIASEEQFKVFTLPKVSAKTKFKLTAHEGCRVRKVALATFASVACEDYAETCLACLTNLGDVHVFSVPGLRPQVHYSCIRKEDISGIASCVFTRHGQGFYLISPSEFERFSLSARNITEPLCSLDINWPRDATQASYRIRESPKLSQANGTPSILLAPQSLDGSPDPAHSMGPDTPEPPEAALSPMSIDSATSADTTLDTTGDVTVEDVKDFLGSSEESEKNLRNLAEDEAHACAILIK

SEQ ID NO: 848069 - protein, 872 aa, Homo sapiens
MMKFRFRRQGADPQREKLKQELFAFNKTVEHGFPNQPSALAFDPELRIMAIGTRSGAVKIYGAPGVEFTGLHRDAATVTQMHFLTGQGRLLSLLDDSSLHLWEIVHHNGCAHLEEALSFQLPSRPGFDGASAPLSLTRVTVVLLVAAGDIAALGTEGSSVFFLDVTTLTLLEGQTLAPGEVLRSVPDDYRCGKDWAPLHSSAITCSAHVASVPAKLWARIVSAGEQQSPQPVSSALSWPITGGRNLAQEPSQRGLLLTGHEDGTVRFWDASGVALRPLYKLSTAGLFQTDCEHADSLAQAAEDDWPPFRKVGCFDPYSDDPRLGVQKVALCKYTAQMVVAGTAGQVLVLELSDVPVEQAVSVAIIDLLQDREGFTWKGHERLSPRTGPLPWPAGFQPRVLVQCLPPAAVTAVTLHTEWSLVAFGTSHGFGLFDYQRKSPVLARCTLHPNDSLAMEGPLSRVKSLKKSLRQSFRRIRKSRVSGKKRAANASSKLQEANAQLAEQACPHDVEMTPVQRRIEPRSADDSLSGVVRCLYFADTFLRDGAHHGPTMWAGTNSGSVFAYALEVPAAAVGGEKRPEQAVEAVLGKEVQLMHRAPVVAIAVLDGRGRPLPEPYEASRDLAQAPDMQGGHAVLIASEEQFKVFTLPKVSAKTKFKLTAHEGCRVRKVALATFASVACEDYAETCLACLTNLGDVHVFSVPGLRPQVHYSCIRKEDISGIASCVFTRHGQGFYLISPSEFERFSLSARNITEPLCSLDINWPRDATQASYRIRESPKLSQANGTPSILLAPQSLDGSPDPAHSMGPDTPEPPEAALSPMSIDSATSADTTLDTTGDVTVEDVKDFLGSSEESEKNLRNLAEDEAHACAILIK

SEQ ID NO: 848070 - protein, 611 aa, Homo sapiens
AAGEAPAAGRKMMKFRFRRQGADPQREKLKQELFAFNKTVEHGFPNQPSALAFDPELRIMAIGTRSGAVKIYGAPGVEFTGLHRDAATVTQMHFLTGQGRLLSLLDDSSLHLWEIVHHNGCAHLEEALSFQLPSRPGFDGASAPLSLTRVTVVLLVAAGDIAALGTEGSSVFFLDVTTLTLLEGQTLAPGEVLRSVPDDYRCGKALGPVESLQGHLRDPTKILIGYSRGLLVIWNQASQCVDHIFLGNQQLESLCWGRDSSTVVSSHSDGSYAVWSVDAGSFPTLQPTVATTPYGPFPCKAINKILWRNCESGGHFIIFSGGMPRASYGDRHCVSVLRAETLVTLDFTSRIIDFFTVHSTRPEDEFDDPQALAVLLEEELVVLDLQTPGWPAVPAPYLAPLHSSAITCSAHVASVPAKLWARIVSAGEQQSPQPVSSALSWPITGGRNLAQEPSQRGLLLTGHEDGTVRFWDASGVALRPLYKLSTAGLFQTDCEHADSLAQAAEDDWPPFRKVGCFDPYSDDPRLGVQKVALCKYTAQMVVAGTAGQVGLGVPWVGDVREGFLEEMSWRVWWKGRWTGTGKSQGGNRALGGAGWGEDRWEVGLSLGEPQC

SEQ ID NO: 848071 - protein, 1064 aa, Homo sapiens
MMKFRFRRQGADPQREKLKQELFAFNKTVEHGFPNQPSALAFDPELRIMAIGTRSGAVKIYGAPGVEFTGLHRDAATVTQMHFLTGQGRLLSLLDDSSLHLWEIVHHNGCAHLEEALSFQLPSRPGFDGASAPLSLTRVTVVLLVAAGDIAALGTEGSSVFFLDVTTLTLLEGQTLAPGEVLRSVPDDYRCGKALGPVESLQGHLRDPTKILIGYSRGLLVIWNQASQCVDHIFLGNQQLESLCWGRDSSTVVSSHSDGSYAVWSVDAGSFPTLQPTVATTPYGPFPCKAINKILWRNCESGGHFIIFSGGMPRASYGDRHCVSVLRAETLVTLDFTSRIIDFFTVHSTRPEDEFDDPQALAVLLEEELVVLDLQTPGWPAVPAPYLAPLHSSAITCSAHVASVPAKLWARIVSAGEQQSPQPVSSALSWPITGGRNLAQEPSQRGLLLTGHEDGTVRFWDASGVALRPLYKLSTAGLFQTDCEHADSLAQAAEDDWPPFRKVGCFDPYSDDPRLGVQKVALCKYTAQMVVAGTAGQVLVLELSDVPVEQAVSVAIIDLLQDREGFTWKGHERLSPRTGPLPWPAGFQPRVLVQCLPPAAVTAVTLHTEWSLVAFGTSHGFGLFDYQRKSPVLARCTLHPNDSLAMEGPLSRVKSLKKSLRQSFRRIRKSRVSGKKRAANASSKLQEANAQLAEQACPHDVEMTPVQRRIEPRSADDSLSGVVRCLYFADTFLRDGAHHGPTMWAGTNSGSVFAYALEVPAAAVGGEKRPEQAVEAVLGKEVQLMHRAPVVAIAVLDGRGRPLPEPYEASRDLAQAPDMQGGHAVLIASEEQFKVFTLPKVSAKTKFKLTAHEGCRVRKVALATFASVACEDYAETCLACLTNLGDVHVFSVPGLRPQVHYSCIRKEDISGIASCVFTRHGQGFYLISPSEFERFSLSARNITEPLCSLDINWPRDATQASYRIRESPKLSQANGTPSILLAPQSLDGSPDPAHSMGPDTPEPPEAALSPMSIDSATSADTTLDTTGDVTVEDVKDFLGSSEESEKNLRNLAEDEAHACAILIK

SEQ ID NO: 848072 - protein, 1096 aa, Homo sapiens; identical to SEQ ID NO: 848067

SEQ ID NO: 848073 - protein, 847 aa, Homo sapiens
MCHRQVVDVTPSYPCVNPDRGQLESLCWGRDSSTVVSSHSDGSYAVWSVDAGSFPTLQPTVATTPYGPFPCKAINKILWRNCESGGHFIIFSGGMPRASYGDRHCVSVLRAETLVTLDFTSRIIDFFTVHSTRPEDEFDDPQALAVLLEEELVVLDLQTPGWPAVPAPYLAPLHSSAITCSAHVASVPAKLWARIVSAGEQQSPQPVSSALSWPITGGRNLAQEPSQRGLLLTGHEDGTVRFWDASGVALRPLYKLSTAGLFQTDCEHADSLAQAAEDDWPPFRKVGCFDPYSDDPRLGVQKVALCKYTAQMVVAGTAGQVLVLELSDVPVEQAVSVAIIDLLQDREGFTWKGHERLSPRTGPLPWPAGFQPRVLVQCLPPAAVTAVTLHTEWSLVAFGTSHGFGLFDYQRKSPVLARCTLHPNDSLAMEGPLSRVKSLKKSLRQSFRRIRKSRVSGKKRAANASSKLQEANAQLAEQACPHDVEMTPVQRRIEPRSADDSLSGVVRCLYFADTFLRDGAHHGPTMWAGTNSGSVFAYALEVPAAAVGGEKRPEQAVEAVLGKEVQLMHRAPVVAIAVLDGRGRPLPEPYEASRDLAQAPDMQGGHAVLIASEEQFKVFTLPKVSAKTKFKLTAHEGCRVRKVALATFASVACEDYAETCLACLTNLGDVHVFSVPGLRPQVHYSCIRKEDISGIASCVFTRHGQGFYLISPSEFERFSLSARNITEPLCSLDINWPRDATQASYRIRESPKLSQANGTPSILLAPQSLDGSPDPAHSMGPDTPEPPEAALSPMSIDSATSADTTLDTTGDVTVEDVKDFLGSSEESEKNLRNLAEDEAHACAILIK

SEQ ID NO: 848074 - protein, 1075 aa, Homo sapiens; identical to SEQ ID NO: 848066

SEQ ID NO: 848075 - protein, 248 aa, Homo sapiens [sequence omitted]

SEQ ID NO: 848076 - protein, 113 aa, Homo sapiens
MLIDTLGASIVNATDSKGRTPLHAAAFTDHVECLQLLLSHNAQVNSVDSTGKTPLMMAAENGQTNTVEMLVSSASAELTLQDNSKNTALHLACSKPSEVPYIHDCLLWLDLHP

SEQ ID NO: 848077 - protein, 80 aa, Homo sapiens
GLGSEAGWSMMPVSSSSPLSSLTFNAINRYTNTSKTVSFEALPIMRNEPSSYCSFNNIGGEQEYLYTDVDELNDSDSETY

SEQ ID NO: 848078 - protein, 1241 aa, Homo sapiens
MRAVLTWRDKAEHCINDIAFKPDGTQLILAAGSRLLVYDTSDGTLLQPLKGHKDTVYCVAYAKDGKRFASGSADKSVIIWTSKLEGILKYTHNDAIQCVSYNPITHQLASCSSSDFGLWSPEQKSVSKHKSSSKIICCSWTNDGQYLALGMFNGIISIRNKNGEEKVKIERPGGSLSPIWSICWNPSSRWESFWMNRENEDAEDVIVNRYIQEIPSTLKSAVYSSQGSEAEEEEPEEEDDSPRDDNLEERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 848079 - protein, 1182 aa, Homo sapiens
MRAVLTWRDKAEHCINDIAFKPDGTQLILAAGSRLLVYDTSDGTLLQPLKGHKDTVYCVAYAKDGKRFASGSADKSVIIWTSKLEGILKYTHNDAIQCVSYNPITHQLASCSSSDFGLWSPEQKSVSKHKSSSKIICCSWTNDGQYLALGMFNGIISIRNKNGEEKVKIERPGGSLSPIWSICWNPSREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 848080 - protein, 1292 aa, Homo sapiens
MRAVLTWRDKAEHCINDIAFKPDGTQLILAAGSRLLVYDTSDGTLLQPLKGHKDTVYCVAYAKDGKRFASGSADKSVIIWTSKLEGILKYTSWSVMSSLHLHLPFLGLHKTVRVTATDKAPKGQGGRIDCLRPSVQNQPGQKHNDAIQCVSYNPITHQLASCSSSDFGLWSPEQKSVSKHKSSSKIICCSWTNDGQYLALGMFNGIISIRNKNGEEKVKIERPGGSLSPIWSICWNPSSRWESFWMNRENEDAEDVIVNRYIQEIPSTLKSAVYSSQGSEAEEEEPEEEDDSPRDDNLEERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 848081 - protein, 1487 aa, Homo sapiens
GRVGAEHCINDIAFKPDGTQLILAAGSRLLVYDTSDGTLLQPLKGHKDTVYCVAYAKDGKRFASGSADKSVIIWTSKLEGILKYTHNDAIQCVSYNPITHQLASCSSSDFGLWSPEQKSVSKHKSSSKIICCSWTNDGQYLALGMFNGIISIRNKNGEEKVKIERPGGSLSPIWSICWNPSREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEVRMQHPWAGGFSSPLRPSHAFLPGLGSFEERQLQLPLGSVPPAQAWPCQLPCASLSTSCSPRSPPGARSQPPAPASALSLASLAPCPPLGKPHTSVPRWLCLYPRPGPRADSYSRNLCPFWNQAVVLQQIYPTLPTHIPSTQPASFFHTSSLKLRARTWFRQTWVHIPAPPSPSSVSIFLHLGFPLSHRYVVRLNEPDSPRAPHGARSMVNGWLMVAAATVIPARGKVPLSAACAGVLGTGTQVTGLGYFGRPLSCFPMAWSSWARRPFPACPPGWPFLLAARPQGPEARVQGEEDTCLPRPLGSPWLFCEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 848082 - protein, 110 aa, Homo sapiens
GLSVLSPACIPCASKVDFTGPCAVHILPKSWGPSKRDVPLTFTQKTRNPTAPSHLPFQPSNKGAAGLCPALTTAKPPPLERQCVLAPGVGLMSTRASAWSYSCLPLDVPF

SEQ ID NO: 848083 - protein, 110 aa, Homo sapiens; identical to SEQ ID NO: 848082

SEQ ID NO: 848084 - protein, 1081 aa, Homo sapiens
MRAVLTWRDKAEHCINDIAFKPDGTQLILAAGSRLLVYDTSDGTLLQPLKGHKDTVYCVAYAKDGLWSPEQKSVSKHKSSSKIICCREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 848085 - protein, 1164 aa, Homo sapiens
MRAVLTWRDKAEHCINDIAFKPDGTQLILAAGSRLLVYDTSDGTLLQPLKGHKDTVYCVAYAKDGKRFASGSADKSVIIWTSKLEGILKYTHNDAIQCVSYNPITHQLASCSSSDFGLWSPEQKSVSKHKSSSKIICCSWTNDGQYLALGMFNGIISIRNKNGEEKVKIERPGGSLSPIWSICWNPSREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 848086 - protein, 171 aa, Homo sapiens
MRAVLTWRDKAEHCINDIAFKPDGTQLILAAGSRLLVYDTSDGTLLQPLKGHKDTVYCVAYAKDGKRFASGSADKSVIIWTSKLEGILKYTHNDAIQCVSYNPITHQLASCSSSDFGLWSPEQKSVSKHKSSSKIICCSWTNDGQPQPGCHYVPLLKGSSRWTILARGSPP

SEQ ID NO: 848087 - protein, 1130 aa, Homo sapiens
MRAVLTWRDKAEHCINDIAFKPDGTQLILAAGSRLLVYDTSDGTLLQPLKGHKDTVYCVAYAKDGLWSPEQKSVSKHKSSSKIICCSWTNDGQYLALGMFNGIISIRNKNGEEKVKIERPGGSLSPIWSICWNPSREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 848088 - protein, 1038 aa, Homo sapiens
MMLYNVSPTILLLINWHLVPPVTLGCGLLNRSLSPNTNQAARSSAAAGQMMVSTDWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 848089 - protein, 136 aa, Homo sapiens
KQYFKLHIWEPLAQRSWLISLPCPGSQERCRPLKHTGWPKTRARPFLVKDVMAQLKTHSQACTHICTYTRVHTCGRKGHRTWSPVTSGYCQLFAGTGHLSSLSLGLLGCSQGEIIPTAQDCGDSQKPFINLRKRSR

SEQ ID NO: 848090 - protein, 33 aa, Homo sapiens
MYRQSLISPCISSSPAVMLRDPPEAQTGLFFFG

SEQ ID NO: 848091 - protein, 1032 aa, Homo sapiens
MFNGIISIRNKNGEEKVKIERPGGSLSPIWSICWNPSREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 848092 - protein, 1035 aa, Homo sapiens
FIKRLGQAVQTGTWRCKKRVSGCHIRSSLSPIWSICWNPSREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 848093 - protein, 174 aa, Homo sapiens
MPGGKSFARPPAPSALSLCPPDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 848094 - protein, 106 aa, Homo sapiens
RSRGIPRCRACAVPVLEGPPLEAYTIQGQYAIPQPDLTKLHQLAMQQSHFPMTHGNTGFSGIESSSPEVKGYWAGLDASAQTTSHELTIPNDLIGCIIGRQGAKNQ

SEQ ID NO: 848095 - protein, 112 aa, Homo sapiens
MHLTSVLCWKEVGSIIGKKGESVKKMREESGARINISEGNCPERIITLAGPTNAIFKAFAMIIDKLEEDISSSVLSMCILCLYFVLKKEEKEAFIVEHVGIVPFIFFSFWDI

SEQ ID NO: 848096 - protein, 103 aa, Homo sapiens
VLHHTYQGESVKKMREESGARINISEGNCPERIITLAGPTNAIFKAFAMIIDKLEEDISSSMTNSTAASRPPVTLRLVVPASQCGSLIGKGDDTGSSRYPSNT

SEQ ID NO: 848097 - protein, 207 aa, Homo sapiens
MAMSLNGIGLQRWSLQVRFEAHSRGGVWKARTVAACAVPVLTTCEDYQKFLTVKSRPKPSSSPVIFAGGQAYTIQGQYAIPQPDLTKLHQLAMQQSHFPMTHGNTGFSGIESSSPEVKGYWAGLDASAQTTSHELTIPNDLIGCSNRLVHETLPCTIPMRYNYNKLQSAYDKQTLNRSIAYSSISHIALVVTSVLITYYRQVTRWVP

SEQ ID NO: 848098 - protein, 178 aa, Homo sapiens
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLETLSPSPPRRA

SEQ ID NO: 848099 - protein, 178 aa, Homo sapiens; identical to SEQ ID NO: 848098

SEQ ID NO: 848100 - protein, 178 aa, Homo sapiens; identical to SEQ ID NO: 848098

SEQ ID NO: 848101 - protein, 178 aa, Homo sapiens; identical to SEQ ID NO: 848098

SEQ ID NO: 848102 - protein, 178 aa, Homo sapiens; identical to SEQ ID NO: 848098

SEQ ID NO: 848103 - protein, 178 aa, Homo sapiens; identical to SEQ ID NO: 848098

SEQ ID NO: 848104 - protein, 178 aa, Homo sapiens; identical to SEQ ID NO: 848098

SEQ ID NO: 848105 - protein, 178 aa, Homo sapiens; identical to SEQ ID NO: 848098

SEQ ID NO: 848106 - protein, 178 aa, Homo sapiens; identical to SEQ ID NO: 848098

SEQ ID NO: 848107 - protein, 178 aa, Homo sapiens; identical to SEQ ID NO: 848098

SEQ ID NO: 848108 - protein, 178 aa, Homo sapiens; identical to SEQ ID NO: 848098

SEQ ID NO: 848109 - protein, 178 aa, Homo sapiens; identical to SEQ ID NO: 848098

SEQ ID NO: 848110 - protein, 178 aa, Homo sapiens; identical to SEQ ID NO: 848098

SEQ ID NO: 848111 - protein, 178 aa, Homo sapiens; identical to SEQ ID NO: 848098

SEQ ID NO: 848112 - protein, 178 aa, Homo sapiens; identical to SEQ ID NO: 848098

SEQ ID NO: 848113 - protein, 178 aa, Homo sapiens; identical to SEQ ID NO: 848098

SEQ ID NO: 848114 - protein, 178 aa, Homo sapiens; identical to SEQ ID NO: 848098

SEQ ID NO: 848115 - protein, 178 aa, Homo sapiens; identical to SEQ ID NO: 848098

SEQ ID NO: 848116 - protein, 119 aa, Homo sapiens
IRHRPRAIFPLSRLAPAVFGFHPQPVTKDLTTQLSGPSLLLAFHNPSLSVSNRSAWSCWRHSLPVPPEGRDHPVPAQAVQLSGHLCRWSGTGTAQAATVRAFPTPPRPCASTLTWRDHL

SEQ ID NO: 848117 - protein, 178 aa, Homo sapiens; identical to SEQ ID NO: 848098

SEQ ID NO: 848118 - protein, 178 aa, Homo sapiens; identical to SEQ ID NO: 848098

SEQ ID NO: 848119 - protein, 178 aa, Homo sapiens; identical to SEQ ID NO: 848098

SEQ ID NO: 848120 - protein, 178 aa, Homo sapiens; identical to SEQ ID NO: 848098

SEQ ID NO: 848121 - protein, 139 aa, Homo sapiens
IRHRPRAIFPLSRLAPAVFGFHPQPVTKDLTTQLSGPSLLLAFHNPSLSVSNRSAWSCWRHSLPVPPEGRDHPVPAQAVQLSGHLCRWSGLYHSRTVCHSTARFDQAAPVGNATVSFSHDAWQHRIQWYGYLSVYFCKV

SEQ ID NO: 848122 - protein, 125 aa, Homo sapiens
IRHRPRAIFPLSRLAPAVFGFHPQPVTKDLTTQLSGPSLLLAFHNPSLSVSNRSAWSCWRHSLPVPPEGRDHPVPAQAVQLSGHLCRWSVDQAAPVGNATVSFSHDAWQHRIQWYGYLSVYFCKV

SEQ ID NO: 848123 - protein, 115 aa, Homo sapiens
IRHRPRAIFPLSRLAPAVFGFHPQPVTKDLTTQLSGPSLLLAFHNPSLSVSNRSAWSCWRHSLPVPPEGRDHPVPAQAVQLSGHLCRWSVDQAAPVGNATVSFSHDAWQHRIQWH

SEQ ID NO: 848124 - protein, 125 aa, Homo sapiens
IRHRPRAIFPLSRLAPAVFGFHPQPVTKDLTTQLSGPSLLLAFHNPSLSVSNRSAWSCWRHSLPVPPEGRDHPVPAQAVQLSGHLCRWSVDQAAPVGNATVSFSHDAWQHRIQCRFGCICSDYFS

SEQ ID NO: 848125 - protein, 178 aa, Homo sapiens; identical to SEQ ID NO: 848098

SEQ ID NO: 848126 - protein, 139 aa, Homo sapiens
IRHRPRAIFPLSRLAPAVFGFHPQPVTKDLTTQLSGPSLLLAFHNPSLSVSNRSAWSCWRHSLPVPPEGRDHPVPAQAVQLSGHLCRWSGLYHSRTVCHSTARFDQAAPVGNATVSFSHDAWQHRIQCRFGCICSDYFS

SEQ ID NO: 848127 - protein, 129 aa, Homo sapiens
IRHRPRAIFPLSRLAPAVFGFHPQPVTKDLTTQLSGPSLLLAFHNPSLSVSNRSAWSCWRHSLPVPPEGRDHPVPAQAVQLSGHLCRWSGLYHSRTVCHSTARFDQAAPVGNATVSFSHDAWQHRIQWH

SEQ ID NO: 848128 - protein, 129 aa, Homo sapiens; identical to SEQ ID NO: 848127

SEQ ID NO: 848129 - protein, 76 aa, Homo sapiens
VYSKEDYSVVNRFESHGGDSHTLSQSPPKGVTIPYRPKPSSSPVIFAGGQFQIFEGGYNNTMKFQLFFWTFILLRH

SEQ ID NO: 848130 - protein, 83 aa, Homo sapiens
MCLNPDLEGPPLEAYTIQGQYAIPQPDLTKLHQLAMQQSHFPMTHGNTGFSGIESSSPEVKGYWGLDASAQTGSVERTGYPLE

SEQ ID NO: 848131 - protein, 129 aa, Homo sapiens
RSLIDVFKQICVVMLDTLSQSPPKGVTIPYRPKPSSSPVIFAGGQAYTIQGQYAIPQPDLTKLHQLAMQQSHFPMTHGNTGFSGIESSSPEVKGYWAGLDASAQTTSHELTIPNDLIGCIIGRQGAKNQ

SEQ ID NO: 848132 - protein, 178 aa, Homo sapiens; identical to SEQ ID NO: 848098

SEQ ID NO: 848133 - protein, 178 aa, Homo sapiens; identical to SEQ ID NO: 848098

SEQ ID NO: 848134 - protein, 178 aa, Homo sapiens; identical to SEQ ID NO: 848098

SEQ ID NO: 848135 - protein, 178 aa, Homo sapiens; identical to SEQ ID NO: 848098

SEQ ID NO: 848136 - protein, 178 aa, Homo sapiens; identical to SEQ ID NO: 848098

SEQ ID NO: 848137 - protein, 178 aa, Homo sapiens; identical to SEQ ID NO: 848098

SEQ ID NO: 848138 - protein, 178 aa, Homo sapiens; identical to SEQ ID NO: 848098

SEQ ID NO: 848139 - protein, 178 aa, Homo sapiens; identical to SEQ ID NO: 848098

SEQ ID NO: 848140 - protein, 178 aa, Homo sapiens; identical to SEQ ID NO: 848098

SEQ ID NO: 848141 - protein, 178 aa, Homo sapiens; identical to SEQ ID NO: 848098

SEQ ID NO: 848142 - protein, 178 aa, Homo sapiens; identical to SEQ ID NO: 848098

SEQ ID NO: 848143 - protein, 178 aa, Homo sapiens; identical to SEQ ID NO: 848098

SEQ ID NO: 848144 - protein, 178 aa, Homo sapiens; identical to SEQ ID NO: 848098

SEQ ID NO: 848145 - protein, 178 aa, Homo sapiens; identical to SEQ ID NO: 848098

SEQ ID NO: 848146 - protein, 178 aa, Homo sapiens; identical to SEQ ID NO: 848098

SEQ ID NO: 848147 - protein, 129 aa, Homo sapiens; identical to SEQ ID NO: 848127

SEQ ID NO: 848148 - protein, 129 aa, Homo sapiens; identical to SEQ ID NO: 848127

SEQ ID NO: 848149 - protein, 178 aa, Homo sapiens; identical to SEQ ID NO: 848098

SEQ ID NO: 848150 - protein, 139 aa, Homo sapiens; identical to SEQ ID NO: 848126

SEQ ID NO: 848151 - protein, 139 aa, Homo sapiens; identical to SEQ ID NO: 848126

SEQ ID NO: 848152 - protein, 115 aa, Homo sapiens; identical to SEQ ID NO: 848123

SEQ ID NO: 848153 - protein, 139 aa, Homo sapiens; identical to SEQ ID NO: 848121

SEQ ID NO: 848154 - protein, 382 aa, Homo sapiens
MNSVSPAAAQYRSSSPEDARRRPEARRPRGPRGPDPNGLGPSGASGPALGSPGAGPSEPDEVDKFKAKFLTAWNNVKYGWVVKSRTSFSKISSIHLCGRRYRFEGEGDIQRFQRDFVSRLWLTYRRDFPPLPGGCLTSDCGWGCMLRSGQMMLAQGLLLHFLPRGKPVESCSDVTRLVVYVSQDCTVYKADVARLVARPDPTAEWKSVVILVPVRLGGETLNPVYVPCVKELLRCELCLGIMGGKPRHSLYFIGYQDDFLLYLDPHYCQPTVDVSQADFPLESFHCTSPRKMAFAKMDPSCTVGFYAGDRKEFETLCSELTRVLSSSSATERYPMFTLAEGHAQDHSLDDLCSQLAQPTLRLPRTGRLLRAKRPSSEDFVFL

SEQ ID NO: 848155 - protein, 463 aa, Homo sapiens
MNSVSPAAAQYRSSSPEDARRRPEARRPRGPRGPDPNGLGPSGASGPALGSPGAGPSEPDEVDKFKAKFLTAWNNVKYGWVVKSRTSFSKISSIHLCGRRYRFEGEGDIQRFQRDFVSRLWLTYRRDFPPLPGGCLTSDCGWGCMLRSGQMMLAQGLLLHFLPRDWTWAEGMGLGPPELSGSASPSRYHGPARWMPPRWAQGAPELEQERRHRQIVSWFADHPRAPFGLHRLVELGQSSGKKAGDWKAVESCSDVTRLVVYVSQDCTVYKADVARLVARPDPTAEWKSVVILVPVRLGGETLNPVYVPCVKELLRCELCLGIMGGKPRHSLYFIGYQDDFLLYLDPHYCQPTVDVSQADFPLESFHCTSPRKMAFAKMDPSCTVGFYAGDRKEFETLCSELTRVLSSSSATERYPMFTLAEGHAQDHSLDDLCSQLAQPTLRLPRTGRLLRAKRPSSEDFVFL

SEQ ID NO: 848156 - protein, 360 aa, Homo sapiens
MNSVSPAAAQYRSSSPEDARRRPEARRPRGPRGPDPNGLGPSGASGPALGSPGAGPSEPDEVDKFKAKFLTAWNNVKYGWVVKSRTSFSKISSIHLCGRRYRFEGEGDIQRFQRDFVSRLWLTYRRDFPPLPGGCLTSDCGWGCMLRSGQMMLAQGLLLHFLPRVYKADVARLVARPDPTAEWKSVVILVPVRLGGETLNPVYVPCVKELLRCELCLGIMGGKPRHSLYFIGYQDDFLLYLDPHYCQPTVDVSQADFPLESFHCTSPRKMAFAKMDPSCTVGFYAGDRKEFETLCSELTRVLSSSSATERYPMFTLAEGHAQDHSLDDLCSQLAQPTLRLPRTGRLLRAKRPSSEDFVFL

SEQ ID NO: 848157 - protein, 446 aa, Homo sapiens
MNSVSPAAAQYRSSSPEDARRRPEARRPRGPRGPDPNGLGPSGASGPALGSPGAGPSEPDEVDKFKAKFLTAWNNVKYGWVVKSRTSFSKISSIHLCGRRYRFEGEGDIQRFQRDFVSRLWLTYRRDFPPLPGGCLTSDCGWGCMLRSGQMMLAQGLLLHFLPRDWTWAEGMGLGPPELSGSASPSRYHGPARWMPPRWAQGAPELEQERRHRQIVSWFADHPRAPFGLHRLVELGQSSGKKAGDWYGPSLVAHILRKAVESCSDVTRLVVYVSQDCTVYKADVARLVARPDPTAEWKSVVILVPVRLGGETLNPVYVPCVKELLRCELCLGIMGGKPRHSLYFIGYQDDFLLYLDPHYCQPTVDVSQADFPLESFHCSSPLSSANSGASCCLSTAFMLAPACSSTWQISTEPLSGGCMHGACVLCSACRSREYELHPAYQPQTHS

SEQ ID NO: 848158 - protein, 164 aa, Homo sapiens
MNSVSPAAAQYRSSSPEDARRRPEARRPRGPRGPDPNGLGPSGASGPALGSPTVDVSQADFPLESFHCTSPRKMAFAKMDPSCTVGFYAGDRKEFETLCSELTRVLSSSSATERYPMFTLAEGHAQDHSLDDLCSQLAQPTLRLPRTGRLLRAKRPSSEDFVFL

SEQ ID NO: 848159 - protein, 474 aa, Homo sapiens
MNSVSPAAAQYRSSSPEDARRRPEARRPRGPRGPDPNGLGPSGASGPALGSPGAGPSEPDEVDKFKAKFLTAWNNVKYGWVVKSRTSFSKISSIHLCGRRYRFEGEGDIQRFQRDFVSRLWLTYRRDFPPLPGGCLTSDCGWGCMLRSGQMMLAQGLLLHFLPRDWTWAEGMGLGPPELSGSASPSRYHGPARWMPPRWAQGAPELEQERRHRQIVSWFADHPRAPFGLHRLVELGQSSGKKAGDWYGPSLVAHILRKAVESCSDVTRLVVYVSQDCTVYKADVARLVARPDPTAEWKSVVILVPVRLGGETLNPVYVPCVKELLRCELCLGIMGGKPRHSLYFIGYQDDFLLYLDPHYCQPTVDVSQADFPLESFHCTSPRKMAFAKMDPSCTVGFYAGDRKEFETLCSELTRVLSSSSATERYPMFTLAEGHAQDHSLDDLCSQLAQPTLRLPRTGRLLRAKRPSSEDFVFL

SEQ ID NO: 848160 - protein, 499 aa, Homo sapiens
MNSVSPAAAQYRSSSPEDARRRPEARRPRGPRGPDPNGLGPSGASGPALGSPGAGPSEPDEVDKFKAKFLTAWNNVKYDGGMEALLLSCKCFISAGRCPYVSPGWVVKSRTSFSKISSIHLCGRRYRFEGEGDIQRFQRDFVSRLWLTYRRDFPPLPGGCLTSDCGWGCMLRSGQMMLAQGLLLHFLPRDWTWAEGMGLGPPELSGSASPSRYHGPARWMPPRWAQGAPELEQERRHRQIVSWFADHPRAPFGLHRLVELGQSSGKKAGDWYGPSLVAHILRKAVESCSDVTRLVVYVSQDCTVYKADVARLVARPDPTAEWKSVVILVPVRLGGETLNPVYVPCVKELLRCELCLGIMGGKPRHSLYFIGYQDDFLLYLDPHYCQPTVDVSQADFPLESFHCTSPRKMAFAKMDPSCTVGFYAGDRKEFETLCSELTRVLSSSSATERYPMFTLAEGHAQDHSLDDLCSQLAQPTLRLPRTGRLLRAKRPSSEDFVFL

SEQ ID NO: 848161 - protein, 141 aa, Homo sapiens
MGGKPRHSLYFIGYQDDFLLYLDPHYCQPTVDVSQADFPLESFHCTSPRKMAFAKMDPSCTVGFYAGDRKEFETLCSELTRVLSSSSATERYPMFTLAEGHAQDHSLDDLCSQLAQPTLRLPRTGRLLRAKRPSSEDFVFL

SEQ ID NO: 848162 - protein, 91 aa, Homo sapiens
GGPEKHLLNKPGLRNMAWHCLWLTLSPSSRQVLSSSSATERYPMFTLAEGHAQDHSLDDLCSQLAQPTLRLPRTGRLLRAKRPSSEDFVFL

SEQ ID NO: 848163 - protein, 910 aa, Homo sapiens
MRRSAAPSQLQGNSFKKPKFIPPGRSNPGLNEEITKLNPDIKLFEGVAINNTFLPSQNDLRICSLNLPSEESTREINNRDNCSGKYCFEAPTLATLDPPHTVHSAPKEVAVSKEQEEKSDSLVKYFSVVWCKPSKKKHKKWEGDAVLIVKGKSFILKNLEGKDIGRGIGYKFKELEKIEEGQTLMICGKEIEVMGVISPDDFSSGRCFQLGGGSTAISHSSQVARKCFSNPFKSVCKPSSKENRQNDFQNCKPRHDPYTPNSLVMPRPDKNHQWVFNKNCFPLVDVVIDPYLVYHLRPHQKEGIIFLYECVMGMRMNGRCGAILADEMGLGKTLQCISLIWTLQCQGPYGGKPVIKKTLIVTPGSLVNNWKKEFQKWLGSERIKIFTVDQDHKVEEFIKSIFYSVLIISYEMLLRSLDQIKNIKFDLLICDEGHRLKNSAIKTTTALISLSCEKRIILTGTPIQNDLQEFFALIDFVNPGILGSLSSYRKIYEEPIILSREPSASEEEKELGERRAAELTCLTGLFILRRTQEIINKYLPPKIENVVFCRPGALQIELYRKLLNSQVVRFCLQGLLENSPHLICIGALKKLCNHPCLLFNSIKEKECSSTCDKNEEKSLYKGLLSVFPADYNPLLFTEKESGKLQVLSKLLAVIHELRPTEKVVLVSNYTQTLNILQEVCKRHGYAYTRLDGQTPISQRQQIVDGFNSQHSSFFIFLLSSKAGGVGLNLIGGSHLILYDIDWNPATDIQAMSRVWRDGQKYPVHIYRLLTTGTIEEKIYQRQISKQGLCGAVVDLTKTSEHIQFSVEELKNLFTLHESSDCVTHDLLDCECTGEEVHTGDSLEKFIVSRDCQLGPHHQKSNSLKPLSMSQLKQWKHFSGDHLNLTDPFLERITENVSFIFQNITTQATGT

SEQ ID NO: 848164 - protein, 599 aa, Homo sapiens
MGMRMNGRCGAILADEMGLGKTLQCISLIWTLQCQGPYGGKPVIKKTLIVTPGSLVNNWKKEFQKWLGSERIKIFTVDQDHKVEEFIKSIFYSVLIISYEMLLRSLDQIKNIKFDLLICDEGHRLKNSAIKTTTALISLSCEKRIILTGTPIQNDLQEFFALIDFVNPGILGSLSSYRKIYEEPIILSREPSASEEEKELGERRAAELTCLTGLFILRRTQEIINKYLPPKIENVVFCRPGALQIELYRKLLNSQVVRFCLQGLLENSPHLICIGALKKLCNHPCLLFNSIKEKECSSTCDKNEEKSLYKGLLSVFPADYNPLLFTEKESGKLQVLSKLLAVIHELRPTEKVVLVSNYTQTLNILQEVCKRHGYAYTRLDGQTPISQRQQIVDGFNSQHSSFFIFLLSSKAGGVGLNLIGGSHLILYDIDWNPATDIQAMSRVWRDGQKYPVHIYRLLTTGTIEEKIYQRQISKQGLCGAVVDLTKTSEHIQFSVEELKNLFTLHESSDCVTHDLLDCECTGEEVHTGDSLEKFIVSRDCQLGPHHQKSNSLKPLSMSQLKQWKHFSGDHLNLTDPFLERITENVSFIFQNITTQATGT

SEQ ID NO: 848165 - protein, 925 aa, Homo sapiens
MRRSAAPSQLQGNSFKKPKFIPPGRSNPGLNEEITKLNPDIKLFEGVAINNTFLPSQNDLRICSLNLPSEESTREINNRDNCSGKYCFEAPTLATLDPPHTVQTWMRRHRLDQFTTVHSAPKEVAVSKEQEEKSDSLVKYFSVVWCKPSKKKHKKWEGDAVLIVKGKSFILKNLEGKDIGRGIGYKFKELEKIEEGQTLMICGKEIEVMGVISPDDFSSGRCFQLGGGSTAISHSSQVARKCFSNPFKSVCKPSSKENRQNDFQNCKPRHDPYTPNSLVMPRPDKNHQWVFNKNCFPLVDVVIDPYLVYHLRPHQKEGIIFLYECVMGMRMNGRCGAILADEMGLGKTLQCISLIWTLQCQGPYGGKPVIKKTLIVTPGSLVNNWKKEFQKWLGSERIKIFTVDQDHKVEEFIKSIFYSVLIISYEMLLRSLDQIKNIKFDLLICDEGHRLKNSAIKTTTALISLSCEKRIILTGTPIQNDLQEFFALIDFVNPGILGSLSSYRKIYEEPIILSREPSASEEEKELGERRAAELTCLTGLFILRRTQEIINKYLPPKIENVVFCRPGALQIELYRKLLNSQVVRFCLQGLLENSPHLICIGALKKLCNHPCLLFNSIKEKECSSTCDKNEEKSLYKGLLSVFPADYNPLLFTEKESGKLQVLSKLLAVIHELRPTEKVVLVSNYTQTLNILQEVCKRHGYAYTRLDGQTPISQRQQIVDGFNSQHSSFFIFLLSSKAGGVGLNLIGGSHLILYDIDWNPATDIQAMSRVWRDGQKYPVHIYRLLTTGTIEEKIYQRQISKQGLCGAVVDLTKTSEHIQFSVEELKNLFTLHESSDCVTHDLLDCECTGEEVHTGDSLEKFIVSRDCQLGPHHQKSNSLKPLSMSQLKQWKHFSGDHLNLTDPFLERITENVSFIFQNITTQATGT

SEQ ID NO: 848166 - protein, 205 aa, Homo sapiens
DGVVCFFLVNLFEFIVDCGVGLNLIGGSHLILYDIDWNPATDIQAMSRVWRDGQKYPVHIYRLLTTGTIEEKIYQRQISKQGLCGAVVDLTKTSEHIQFSVEELKNLFTLHESSDCVTHDLLDCECTGEEVHTGDSLEKFIVSRDCQLGPHHQKSNSLKPLSMSQLKQWKHFSGDHLNLTDPFLERITENVSFIFQNITTQATGT

SEQ ID NO: 848167 - protein, 140 aa, Homo sapiens
MPKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKAETVGPGREEGCWQRGRPNEETTCPSSRS

SEQ ID NO: 848168 - protein, 162 aa, Homo sapiens
MDSCQPFRNFRPTGGTSAITCPPVTNVPRKDFVQSRFTESPKCPRARDPWARTLIRPQRFANRLYGRRLGILGWAGTSRVPCDSRSVPEAFMAAFRGLPPAINQFTQALDRQTATQLLKLAHKYRPETKQEKKAETVGPGREEGCWQRGRPNEETTCPSSRS

SEQ ID NO: 848169 - protein, 169 aa, Homo sapiens
TTPHHPPPPQLGSVSKPVLRGSTIRLVRAVRDAKEEAGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKAETVGPGREEGCWQRGRPNEETTCPSSRS

SEQ ID NO: 848170 - protein, 115 aa, Homo sapiens
MLGTSLGVKSDEGICIGQDIQPKRDLTRFVKWPRYIRLQRQRAILYKRLKVPPAINQFTQALDRQTATQLLKLAHKYRPETKQEKKAETVGPGREEGCWQRGRPNEETTCPSSRS

SEQ ID NO: 848171 - protein, 126 aa, Homo sapiens
TNKPPNNCMMGRVYGRGPLRKCYEVWHGQDIQPKRDLTRFVKWPRYIRLQRQRAILYKRLKVPPAINQFTQALDRQTATQLLKLAHKYRPETKQEKKAETVGPGREEGCWQRGRPNEETTCPSSRS

SEQ ID NO: 848172 - protein, 107 aa, Homo sapiens
MAGSEAVVGQDIQPKRDLTRFVKWPRYIRLQRQRAILYKRLKVPPAINQFTQALDRQTATQLLKLAHKYRPETKQEKKAETVGPGREEGCWQRGRPNEETTCPSSRS

SEQ ID NO: 848173 - protein, 67 aa, Homo sapiens
AAARPAARDDRRGRLVHRRLHHVAHTGELGRQRALWLSLVERYQDQFTMTDYDEIRRHLGLANVLGS

SEQ ID NO: 848174 - protein, 140 aa, Homo sapiens; identical to SEQ ID NO: 848167

SEQ ID NO: 848175 - protein, 140 aa, Homo sapiens; identical to SEQ ID NO: 848167

SEQ ID NO: 848176 - protein, 140 aa, Homo sapiens; identical to SEQ ID NO: 848167

SEQ ID NO: 848177 - protein, 140 aa, Homo sapiens; identical to SEQ ID NO: 848167

SEQ ID NO: 848178 - protein, 140 aa, Homo sapiens; identical to SEQ ID NO: 848167

SEQ ID NO: 848179 - protein, 113 aa, Homo sapiens
MEFEPHSVSPFTSQGQDIQPKRDLTRFVKWPRYIRLQRQRAILYKRLKVPPAINQFTQALDRQTATQLLKLAHKYRPETKQEKKAETVGPGREEGCWQRGRPNEETTCPSSRS

SEQ ID NO: 848180 - protein, 140 aa, Homo sapiens; identical to SEQ ID NO: 848167

SEQ ID NO: 848181 - protein, 140 aa, Homo sapiens; identical to SEQ ID NO: 848167

SEQ ID NO: 848182 - protein, 140 aa, Homo sapiens; identical to SEQ ID NO: 848167

SEQ ID NO: 848183 - protein, 140 aa, Homo sapiens; identical to SEQ ID NO: 848167

SEQ ID NO: 848184 - protein, 140 aa, Homo sapiens; identical to SEQ ID NO: 848167

SEQ ID NO: 848185 - protein, 74 aa, Homo sapiens
FAAASTLLPPPKMPKGKKAKGKKVAPAPAVVKKQEAKKVVNPLFEKRPKNFGIGQDIQPKRDLTRFVKWPRYIR

SEQ ID NO: 848186 - protein, 140 aa, Homo sapiens; identical to SEQ ID NO: 848167

SEQ ID NO: 848187 - protein, 140 aa, Homo sapiens; identical to SEQ ID NO: 848167

SEQ ID NO: 848188 - protein, 287 aa, Homo sapiens
MPKGKKAKGKKVAPAPAVVKKQEAKKVVNPLFDEQWSYMNFLCIGIREQPDPNRDPHPSFVKLAPSIVRLQSADETIRLYSWREIVPSWRFRAMFTQGPVVTDERQRSSGWLERLGSTEVTMTQGDHKREEQAQRAALVGARGARYMKGWVGQRGTCPQTERSTYLGPFDAGRLPPVTYRCVDEAEEKAQIVVSELHTTMDSQIELVVFLPALCRKMGVPYCIIKGTGKTGTSSPQEDLHHCRLHTGELGRQRALWLSWVERYQDQFTMTDYDEIRRHLGLANVLGS

SEQ ID NO: 848189 - protein, 66 aa, Homo sapiens
MPKGKKAKGKKVAPAPAVVKKQEAKKVVNPLFEKRPKNFGIAKAYPPQKRTLLPFVGNEAPLIKSS

SEQ ID NO: 848190 - protein, 140 aa, Homo sapiens; identical to SEQ ID NO: 848167

SEQ ID NO: 848191 - protein, 202 aa, Homo sapiens
LDALEEEKGTGENVAPAPDCLDETREAISSGLISLILDDTDGPTEFWHWTGHPEATTEDLTALLWKVGPPTIFMGCHVSGRRRPPLLGWVEKCLLGFRSGQPYVPVVHPTIASYLDACCKGWTRANDTRTRGDRQSVEQRLLARAEKKAAGKGDVPTKRPPVLRAGVNTVTTLVENKKAQLDGDCTRRGSHRAGCLLACPVS

SEQ ID NO: 848192 - protein, 149 aa, Homo sapiens
VFPVTPLCFPDADVVYFPVTELWFWQLRKKQEAKKVVNPLFEKRPKNFGIGQDIQPKRDLTRFVKWPRYIRLQRQRAILYKRLKVPPAINQFTQALDRQTATQLLKLAHKYRPETKQEKKAETVGPGREEGCWQRGRPNEETTCPSSRS

SEQ ID NO: 848193 - protein, 140 aa, Homo sapiens; identical to SEQ ID NO: 848167

SEQ ID NO: 848194 - protein, 140 aa, Homo sapiens; identical to SEQ ID NO: 848167

SEQ ID NO: 848195 - protein, 140 aa, Homo sapiens; identical to SEQ ID NO: 848167

SEQ ID NO: 848196 - protein, 140 aa, Homo sapiens; identical to SEQ ID NO: 848167

SEQ ID NO: 848197 - protein, 140 aa, Homo sapiens; identical to SEQ ID NO: 848167

SEQ ID NO: 848198 - protein, 140 aa, Homo sapiens; identical to SEQ ID NO: 848167

SEQ ID NO: 848199 - protein, 140 aa, Homo sapiens; identical to SEQ ID NO: 848167

SEQ ID NO: 848200 - protein, 140 aa, Homo sapiens; identical to SEQ ID NO: 848167

SEQ ID NO: 848201 - protein, 140 aa, Homo sapiens; identical to SEQ ID NO: 848167

SEQ ID NO: 848202 - protein, 139 aa, Homo sapiens
MPKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKAETVGPGREEGCWQRGRPNEETTCPSSR

SEQ ID NO: 848203 - protein, 190 aa, Homo sapiens
MPKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKAETVGPGREEGCWQRGRPNEETTCPSSSWLSSCLPCVVKWGSLTALSREQARLGRLVHRKTCTTVAFTQVNSEDKGRFG

SEQ ID NO: 848204 - protein, 139 aa, Homo sapiens; identical to SEQ ID NO: 848202

SEQ ID NO: 848205 - protein, 118 aa, Homo sapiens
MPKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKEDKGRFG

SEQ ID NO: 848206 - protein, 151 aa, Homo sapiens
RPNRVCLHCYAFLTGNVLPEAKEDKRRGILEKGSSATPDQSLMCSFLQLIGDKWGKSGPRGWCVIPRDDPLVLYVYAAPQDMRAHTSIPLLGYQVTVGPQGDPRVFQLQQSGQLYTFKAETEELKGRWVKAMERAASGWSPSWPNDGDLSD

SEQ ID NO: 848207 - protein, 106 aa, Homo sapiens
RIPRYELLLKEYIKKLPAQAPDQADAQKALDMIFSAAQHSNAAITEMERLQDLWEVYQRLGLEDDIVDPSNTLLREGPVLKISFRRNDPMERYLFLVSLSLLKIQN

SEQ ID NO: 848208 - protein, 133 aa, Homo sapiens
RIPRYELLLKEYIKKLPAQAPDQADAQKALDMIFSAAQHSNAAITEMERLQDLWEVYQRLGLEDDIVDPSNTLLREGPVLKISFRRNDPMERYLFLVSFKAETEELKGRWVKAMERAASGWSPSWPNDGDLSD

SEQ ID NO: 848209 - protein, 244 aa, Homo sapiens
MVIMSEFSADPAGQGQGQQKPLRVGFYDIERTLGKGNFAVVKLARHRVTKTQVAIKIIDKTRLDSSNLEKIYREVQLMKLLNHPHIIKLCYGKKDMLYIVTEFAKNGEMFDYLTSNGHLSENEARKKFWQILSAVEYCHDHHIVHRDLKTENLLLDGNMDIKLAVGNFYKSGEPLSTWCGSPPYAAPEVFEGKEYEGPQLDIWSLGVVLYVLVCGSLPFDGPNLPTLRQRVLEGRFRIPFFMSQ

SEQ ID NO: 848210 - protein, 469 aa, Homo sapiens
MLESIRVTEKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 848211 - protein, 113 aa, Homo sapiens
MVATGWARRSGLHPAPRPLRGAQEALAKNLWREERNRPLILSSLIISKYLLWNLVEKIVILDRLLVLQRYNPKIVKSYFKTPKRKNTSGYFIIYTVYICVWMLLFLNSENVLS

SEQ ID NO: 848212 - protein, 526 aa, Homo sapiens
GLERWVMAGCTRKLTHLRKRIHRPRRRTTRRWKRWFKFRKRKGEKRPRPNHKAVARRAKLKFSTSEKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 848213 - protein, 497 aa, Homo sapiens
GYVTVAGSKRCWAPYRPPCVPSSSYGLVEALLTVSVEKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 848214 - protein, 507 aa, Homo sapiens
MVATGWARRSGLHPAPRPLRGAQEALAKNLWREERNRPLILSSLIIKKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 848215 - protein, 507 aa, Homo sapiens; identical to SEQ ID NO: 848214

SEQ ID NO: 848216 - protein, 507 aa, Homo sapiens; identical to SEQ ID NO: 848214

SEQ ID NO: 848217 - protein, 1665 aa, Homo sapiens
KLLVGSRRLVDVMDVNTQKGTEMSMSQFVRYYETPEAQRDKLYNVISLEFSHTKLEHLVKRPTVVDLVDWVDNMWPQHLKEKQTEATNAIAEMKYPKVKKYCLMSVKGCFTDFHIDFGGTSVWYHVFRGGKIFWLIPPTLHNLALYEEWVLSGKQSDIFLGDRVERCQRIELKQGYTFFIPSGWIHAVYTPVDSLVFGGNILHSFNVPMQLRIYEIEDRTRVQPKFRYPFYYEMCWYVLERYVYCVTQRSHLTQEYQRESMLIDAPRKPSIDGFSSDSWLEMEEEACDQQPQEEEEKDEEGEGRDRAPKPPTDGSTSPTSTPSEDQEALGKKPKAPALRFLKRTLSNESEESVKSTTLAVDYPKTPTGSPATEVSAKWTHLTEFELKGLKALVEKLESLPENKKCVPEGIEDPQALLEGVKNVLKEHADDDPSLAITGVPVVTWPKKTPKNRAVGRPKGKLGPASAVKLAANRTTAGARRRRTRCRKCEACLRTECGECHFCKDMKKFGGPGRMKQSCIMRQCIAPVLPHTAVCLVCGEAGKEDTVEEEEGKFNLMLMECSICNEIIHPGCLKVSGPVGTGGADALGQVGLLEMLVRWWDAGRAVNSWRTPESGDPVCQGISPGQGGPGVPQRPSVIKGINTPPPPRMSEPERVSRASADGKHRLLVCSWARGSASRWLQASGRTRPHTTLLPPAPSESPLQSPFCMPGAELMALPGSYPPSEMGTLTFMAEGTSPQRRSVLPRVPEKQRGSASEPWPGSTAARLCQPLQLCFLLPGNGIDVTLGRGCCCFWKTWRHRALCPWAIFSARPSSESWCSPQIKESEGVVNDELPNCWECPKCNHAGKTGKQKRGPGFKYASNLPGSLLKEQKMNRDNKEGQEPAKRRSECEEAPRRRSDEHSKKVPPDGLLRRKSDDVHLRKKRKYEKPQELSGRKRASSLQTSPGSSSHLSPRPPLGSSLSPWWRSSLTYFQQQVLPRRSPPEAPGTGESWAVPHPTPLVLHPTAASPEASQVSAPDLWLVVLAWGLGSCLCLEPLLVGMEAVIQGTSEEPGGPAPPTGRAVTSHKVAPGVSPSSSHSCWAGDSHRAVLQNWLPEPRMIGMGGCTSPGLWGGRSVGWEQFNCTPTSSFFLESCRQGSPVCRSDVEMAFVGKASLQPLLWRLWTRGGVGCRGDQIPRARGASSASFLFRDSSNLAKKISFSGKRYHLPLPPVPQAERLELHRSSLGHSPVAGGREALGGRSPEPQRLTRLRSRPQRRSWKNAEDRMALANKPLRRFKQEPEDELPEAPPKTRESDHSRSSSPTAGPSTEGAEGPEEKKKVKMRRKRRLPNKELSRELSKELNHEIQRTENSLANENQQPIKSEPESEGEEPKRPPGICERPHRFSKGLNGTPRELRHQLGPSLRSPPRVISRPPPSVSPPKCIQMERHVIRPPPISPPPDSLPLDDGAAHVMHREVWMAVFSYLSHQDLCVCMRVCRTWNRWCCDKRLWTRIDLNHCKSITPLMLSGIIRRQPVSLDLSWTNISKKQLSWLINRLPGLRDLVLSGCSWIAVSALCSSSCPLLRTLDVQWVEGLKDAQMRDLLSPPTDNRPGELPGWGFLWGWGERARLLDLLLPSDPSCSPKDIGMSLCCHVLSLLQAQRGSGRRQGLLCTRETRSWGSACVSLLSC

SEQ ID NO: 848218 - protein, 776 aa, Homo sapiens
MAMSVSAEDDDYESEPDQNRAVGRPKGKLGPASAVKLAANRTTAGARRRRTRCRKCEACLRTECGECHFCKDMKKFGGPGRMKQSCIMRQCIAPVLPHTAVCLVCGEAGKEDTVEEEEGKFNLMLMECSICNEIIHPGCLKIKESEGVVNDELPNCWECPKCNHAGKTGKQKRGPGFKYASNLPGSLLKEQKMNRDNKEGQEPAKRRSECEEAPRRRSDEHSKKVPPDGLLRRKSDDVHLRKKRKYEKPQELSGRKRASSLQTSPGSSSHLSPRPPLGSSLSPWWRSSLTYFQQQLKPGKEDKLFRKKRRSWKNAEDRMALANKPLRRFKQEPEDELPEAPPKTRESDHSRSSSPTAGPSTEGAEGPEEKKKVKMRRKRRLPNKELSRELSKELNHEIQRTENSLANENQQPIKSEPESEGEEPKRPPGICERPHRFSKGLNGTPRELRHQLGPSLRSPPRVISRPPPSVSPPKCIQMERHVIRPPPISPPPDSLPLDDGAAHVMHREVWMAVFSYLSHQDLCVCMRVCRTWNRWCCDKRLWTRIDLNHCKSITPLMLSGIIRRQPVSLDLSWTNISKKQLSWLINRLPGLRDLVLSGCSWIAVSALCSSSCPLLRTLDVQWVEGLKDAQMRDLLSPPTDNRPGQMDNRSKLRNIVELRLAGLDITDASLRLIIRHMPLLSKLHLSYCNHVTDQSINLLTAVGTTTRDSLTEINLSDCNKVTDQCLSFFKRCGNICHIDLRYCKQVTKEGCEQFIAEMSVSVQFGQVEEKLLQKLS

SEQ ID NO: 848219 - protein, 1208 aa, Homo sapiens
KLLVGSRRLVDVMDVNTQKGTEMSMSQFVRYYETPEAQRDKLYNVISLEFSHTKLEHLVKRPTVVDLVDWVDNMWPQHLKEKQTEATNAIAEMKYPKVKKYCLMSVKGCFTDFHIDFGGTSVWYHVFRGGKIFWLIPPTLHNLALYEEWVLSGKQSDIFLGDRVERCQRIELKQGYTFFIPSGWIHAVYTPVDSLVFGGNILHSFNVPMQLRIYEIEDRTRVQPKFRYPFYYEMCWYVLERYVYCVTQRSHLTQEYQRESMLIDAPRKPSIDGFSSDSWLEMEEEACDQQPQEEEEKDEEGEGRDRAPKPPTDGSTSPTSTPSEDQEALGKKPKAPALRFLKRTLSNESEESVKSTTLAVDYPKTPTGSPATEVSAKWTHLTEFELKGLKALVEKLESLPENKKCVPEGIEDPQALLEGVKNVLKEHADDDPSLAITGVPVVTWPKKTPKNRAVGRPKGKLGPASAVKLAANRTTAGARRRRTRCRKCEACLRTECGECHFCKDMKKFGGPGRMKQSCIMRQCIAPVLPHTAVCLVCGEAGKEDTVEEEEGKFNLMLMECSICNEIIHPGCLKIKESEGVVNDELPNCWECPKCNHAGKTGKQKRGPGFKYASNLPGSLLKEQKMNRDNKEGQEPAKRRSECEEAPRRRSDEHSKKVPPDGLLRRKSDDVHLRKKRKYEKPQELSGRKRASSLQTSPGSSSHLSPRPPLGSSLSPWWRSSLTYFQQQLKPGKEDKLFRKKRRSWKNAEDRMALANKPLRRFKQEPEDELPEAPPKTRESDHSRSSSPTAGPSTEGAEGPEEKKKVKMRRKRRLPNKELSRELSKELNHEIQRTENSLANENQQPIKSEPESEGEEPKRPPGICERPHRFSKGLNGTPRELRHQLGPSLRSPPRVISRPPPSVSPPKCIQMERHVIRPPPISPPPDSLPLDDGAAHVMHREVWMAVFSYLSHQDLCVCMRVCRTWNRWCCDKRLWTRIDLNHCKSITPLMLSGIIRRQPVSLDLSWTNISKKQLSWLINRLPGLRDLVLSGCSWIAVSALCSSSCPLLRTLDVQWVEGLKDAQMRDLLSPPTDNRPGQMDNRSKLRNIVELRLAGLDITDASLRLIIRHMPLLSKLHLSYCNHVTDQSINLLTAVGTTTRDSLTEINLSDCNKVTDQCLSFFKRCGNICHIDLRYCKQVTKEGCEQFIAEMSVSVQFGQVEEKLLQKLS

SEQ ID NO: 848220 - protein, 403 aa, Homo sapiens
KLLVGSRRLVDVMDVNTQKGTEMSMSQFVRYYETPEAQRDKLYNVISLEFSHTKLEHLVKRPTVVDLVDWVDNMWPQHLKEKQTEATNAIAEMKYPKVKKYCLMSVKGCFTDFHIDFGGTSVWYHVFRGGKIFWLIPPTLHNLALYEEWVLSGKQSDIFLGDRVERCQRIELKQGYTFFIPSGWIHAVYTPVDSLVFGGNILHSFNVPMQLRIYEIEDRTRVQPKFRYPFYYEMCWYVLERYVYCVTQRSHLTQEYQRESMLIDAPRKPSIDGFSSDSWLEMEEEACDQQPQEEEEKDEEGEGRDRAPKPPTDGSTSPTSTPSEDQEALGKKPKAPALRFLKRTLSNESEESVKSTTLAVDYPKTPTGSPATEVSAKWTHTAIRSLISACPSSNAVETSVILT

SEQ ID NO: 848221 - protein, 767 aa, Homo sapiens
MAMSVSAEDDDYESEPDQNRAVGRPKGKLGPASAVKLAANRTTAGARRRRTRCRKCEACLRTECGECHFCKDMKKFGGPGRMKQSCIMRQCIAPVLPHTAVCLVCGEAGKEDTVEEEEGKFNLMLMECSICNEIIHPGCLKIKESEGVVNDELPNCWECPKCNHAGKTGKQKRGPGFKYASNLPGSLLKEQKMNRDNKEGQEPAKRRSECEEAPRRRSDEHSKKVPPDGLLRRKSDDVHLRKKRKYEKPQELSGRKRASSLQTSPGSSSHLSPRPPLGSSLSPWWRSSLTYFQQQLKPGKEDKLFRKKRRSWKNAEDRMALANKPLRRFKQEPEDELPEAPPKTRESDHSRSSSPTAGPSTEGAEGPEEKKKVKMRRKRRLPNKELSRELSKELNHEIQRTENSLANENQQPIKSEPESEGEEPKRPPGICERPHRFSKGLNGTPRELRHQLGPSLRSPPRVISRPPPSVSPPKCIQMERHVIRPPPISPPPDSLPLDDGAAHVMHREVWMAVFSYLSHQDLCVCMRVCRTWNRWCCDKRLWTRIDLNHCKSITPLMLSGIIRRQPVSLDLSWTNISKKQLSWLINRLPGLRDLVLSGCSWIAVSALCSSSCPLLRTLDVQWVEGLKDAQMRDLLSPPTDNRPGQMDNRSKLRNIVELRLAGLDITDASLRLIIRHMPLLSKLHLSYCNHVTDQSINLLTAVGTTTRDSLTEINLSDCNKVTDQCLSFFKRCGNICHIDLRYCKQVTKEGCEQFIAEMSVRGDQRES

SEQ ID NO: 848222 - protein, 1208 aa, Homo sapiens; identical to SEQ ID NO: 848219

SEQ ID NO: 848223 - protein, 1175 aa, Homo sapiens
KLLVGSRRLVDVMDVNTQKGTEMSMSQFVRYYETPEAQRDKLYNVISLEFSHTKLEHLVKRPTVVDLVDWVDNMWPQHLKEKQTEATNAIAEMKYPKVKKYCLMSVKGCFTDFHIDFGGTSVWYHVFRGGKIFWLIPPTLHNLALYEEWVLSGKQSDIFLGDRVERCQRIELKQGYTFFIPSGWIHAVYTPVDSLVFGGNILHSFNVPMQLRIYEIEDRTRVQPKFRYPFYYEMCWYVLERYVYCVTQRSHLTQEYQRESMLIDAPRKPSIDGFSSDSWLEMEEEACDQQPQEEEEKDEEGEGRDRAPKPPTDGSTSPTSTPSEDQEALGKKPKAPALRFLKRTLSNESEESVKSTTLAVDYPKTPTGSPATEVSAKWTHLTEFELKGLKALVEKLESLPENKKCVPEGIEDPQALLEGVKNVLKEHADDDPSLAITGVPVVTWPKKTPKNRAVGRPKGKLGPASAVKLAANRTTAGARRRRTRCRKCEACLRTECGECHFCKDMKKFGGPGRMKQSCIMRQCIAPVLPHTAVCLVCGEAGKEDTVEEEEGKFNLMLMECSICNEIIHPGCLKIKESEGVVNDELPNCWECPKCNHAGKTGKQKRGPGFKYASNLPGSLLKEQKMNRDNKEGQEPAKRRSECEEAPRRRSDEHSKKVPPDGLLRRKSDDVHLRKKRKYEKPQELSGRKRASSLQTSPGSSSHLSPRPPLGSSLSPWWRSSLTYFQQQLKPGKEDKLFRKKRRSWKNAEDRMALANKPLRRFKQEPEDELPEAPPKTRESDHSRSSSPTAGPSTEGAEGPEEKKKVKMRRKRRLPNKELSRELSKELNHEIQRTENSLANENQQPIKSEPESEGEEPKRPPGICERPHRFSKGLNGTPRELRHQLGPSLRSPPRVISRPPPSVSPPKCIQMERHVIRPPPISPPPDSLPLDDGAAHVMHREVWMAVFSYLSHQDLCVCMRVCRTWNRWCCDKRLWTRIDLNHCKSITPLMLSGIIRRQPVSLDLSWTNISKKQLSWLINRLPGLRDLVLSGCSWIAVSALCSSSCPLLRTLDVQWVEGLKDAQMRDLLSPPTDNRPGQMDNRSKLRNIVELRLAGLDITDASLRLIIRHMPLLSKLHLSYCNHVTDQSINLLTAVGTTTRDSLTEINLSASLLGRVFGLQFWGICEPQARKNAGWA

SEQ ID NO: 848224 - protein, 774 aa, Homo sapiens
MAMSVSAEDDDYESEPDQNRAVGRPKGKLGPASAVKLAANRTTAGARRRRTRCRKCEACLRTECGECHFCKDMKKFGGPGRMKQSCIMRQCIAPVLPHTAVCLVCGEAGKEDTVEEEEGKFNLMLMECSICNEIIHPGCLKIKESEGVVNDELPNCWECPKCNHAGKTGKQKRGPGFKYASNLPGSLLKEQKMNRDNKEGQEPAKRRSECEEAPRRRSDEHSKKVPPDGLLRRKSDDVHLRKKRKYEKPQELSGRKRASSLQTSPGSSSHLSPRPPLGSSLSPWWRSSLTYFQQQLKPGKEDKLFRKKRRSWKNAEDRMALANKPLRRFKQEPEDELPEAPPKTRESDHSRSSSPTAGPSTEGAEGPEEKKKVKMRRKRRLPNKELSRELSKELNHEIQRTENSLANENQQPIKSEPESEGEEPKRPPGICERPHRFSKGLNGTPRELRHQLGPSLRSPPRVISRPPPSVSPPKCIQMERHVIRPPPISPPPDSLPLDDGAAHVMHREVWMAVFSYLSHQDLCVCMRVCRTWNRWCCDKRLWTRIDLNHCKSITPLMLSGIIRRQPVSLDLSWTNISKKQLSWLINRLPGLRDLVLSGCSWIAVSALCSSSCPLLRTLDVQWVEGLKDAQMRDLLSPPTDNRPGQMDNRSKLRNIVELRLAGLDITDASLRLIIRHMPLLSKLHLSYCNHVTDQSINLLTAVGTTTRDSLTEINLSDCNKVTDQCLSFFKRCGNICHIDLRYCKQVTKEGCEQFIAEMSSFQGRSCSTTRLGDE

SEQ ID NO: 848225 - protein, 351 aa, Homo sapiens
MPGSAAKGSELSERIESFVETLKRGGGPRSSEEMARETLGLLRQIITDHRWSNAGELMELIRREGRRMTAAQPSETTVGNMVRRVLKIIREEYGRLHGRSDESDQQESLHKLLTSGGLNEDFSFHYAQLQSNIIEAINELLVELEGTMENIAAQALEHIHSNEVIMTIGFSRTVEAFLKEAARKRKFHVIVAECAPFCQGHEMAVNLSKAGIETTVMTDAAIFAVMSRVNKVIIGTKTILANGALRAVTGTHTLALAAKHHSTPLIVCAPMFKLSPQFPNEEDSFHKFVAPEEVLPFTEGDILEKVSVHCPVFDYVPPELITLFISNIGGNAPSYIYRLMSELYHPDDHVL

SEQ ID NO: 848226 - protein, 365 aa, Homo sapiens
MPGSAAKGSELSERIESFVETLKRGGGPRSSEEMARETLGLLRQIITDHRWSNAGELMELIRREGRRMTAAQPSETTVGNMVRRVLKIIREEYGRLHGRSDESDQQESLHKLLTSGGLNEDFSFHYAQLQSNIIEAINELLVELEGTMENIAAQALEHIHSNEVIMTIGFSRTVEAFLKEAARKRKFHVIVAECAPFCQGHEMAVNLSKAGIETTVMTDAAIFAVMSRVNKVIIGTKTILANGALRAVTGTHTLALAAKHHSTPLIVCAPMFKLSPQFPNEMSLLHWGTVEFPNEEDSFHKFVAPEEVLPFTEGDILEKVSVHCPVFDYVPPELITLFISNIGGNAPSYIYRLMSELYHPDDHVL

SEQ ID NO: 848227 - protein, 283 aa, Homo sapiens
MPGSAAKGSELSERIESFVETLKRGGGPRSSEEMARETLGLLRQIITDHRWSNAGELMELIRREGRRMTAAQPSETTVGNMVRRVLKIIREEYGRLHGRSDESDQQESLHKLLTSGGLNEDFSFHYAQLQSNIIEAINELLVELEGTMENIAAQALEHIHSNEVIMTIGFSRTVEAFLKEAARKRKFHVIVAECAPFCQGHEMAVNLSKAGIETTVMTDAAIFAVMSRVNKVIIGTKTILANGALRAVTGTHTLALAAKHHSTPLIVCAPMFKLSPQGLSFVT

SEQ ID NO: 848228 - protein, 241 aa, Homo sapiens
MPGSAAKGSELSERIESFVETLKRGGGPRSSEEMARETLGLLRQIITDHRWSNAGELMELIRREGRRMTAAQPSETTVGNMVRRVLKIIREEYGRLHGRSDESDQQESLHKLLTSGGLNEDFSFHYAQLQSNIIEAINELLVELEGTMENIAAQALEHIHSNEVIMTIGFSRTVEAFLKEAARKRKFHVIVAECAPFCQGHEMAVNLSKAGIETTVMTDAAIFAVMSRVNKVGISGVMLNS

SEQ ID NO: 848229 - protein, 220 aa, Homo sapiens
MPGSAAKGSELSERIESFVETLKRGGGPRSSEEMARETLGLLRQIITDHRWSNAGELMELIRREGRRMTAAQPSETTVGNMVRRVLKIIREEYGRLHGRSDESDQQESLHKLLTSGGLNEDFSFHYAQLQSNIIEAINELLVELEGTMENIAAQALEHIHSNEVIMTIGFSRTVEAFLKEAARKRKFHVIVAECAPFCQLENSPVAWIVSCLGVLFSGFF

SEQ ID NO: 848230 - protein, 299 aa, Homo sapiens
MPGSAAKGSELSERIESFVETLKRGGGPRSSEEMARETLGLLRQIITDHRWSNAGELMELIRREGRRMTAAQPSETTVGNMVRRVLKIIREEYGRLHGRSDESDQQESLHKLLTSGGLNEDFSFHYAQLQSNIIEAINELLVELEGTMENIAAQALEHIHSNEVIMTIGFSRTVEAFLKEAARKRKFHVIVAECAPFCQGHEMAVNLSKAGIETTVMTDAAIFAVMSRVNKVIIGTKTILANGALRAVTGTHTLALAAKHHSTQHVGPFQLPQAMKTSSGLKSPQGFEGSLRTEILSRG

SEQ ID NO: 848231 - protein, 318 aa, Homo sapiens
MARETLGLLRQIITDHRWSNAGELMELIRREGRRMTAAQPSETTVGNMVRRVLKIIREEYGRLHGRSDESDQQESLHKLLTSGGLNEDFSFHYAQLQSNIIEAINELLVELEGTMENIAAQALEHIHSNEVIMTIGFSRTVEAFLKEAARKRKFHVIVAECAPFCQGHEMAVNLSKAGIETTVMTDAAIFAVMSRVNKVIIGTKTILANGALRAVTGTHTLALAAKHHSTPLIVCAPMFKLSPQFPNEEDSFHKFVAPEEVLPFTEGDILEKVSVHCPVFDYVPPELITLFISNIGGNAPSYIYRLMSELYHPDDHVL

SEQ ID NO: 848232 - protein, 206 aa, Homo sapiens
MPGSAAKGSELSERIESFVETLKRGGGPRSSEEMARETLGLLRQIITDHRWSNAGELMELIRREGRRMTAAQPSETTVGNMVRRVLKIIREEYGRLHGRSDESDQQESLHKLLTSGGLNEDFSFHYAQLQSNIIEAINELLVELEGTMENIAAQALEHIHSNEVIMTIGFSRTVEAFLKEAARKRKFHVIVAECAPFCQQVLRQLS

SEQ ID NO: 848233 - protein, 199 aa, Homo sapiens
MPGSAAKGSELSERIESFVETLKRGGGPRSSEEMARETLGLLRQIITDHRWSNAGELMELIRREGRRMTAAQPSETTVGNMVRRVLKIIREEYGRLHGRSDESDQQESLHKLLTSGGLNEDFSFHYAQLQSNIIEAINELLVELEGTMENIAAQALEHIHSNEVIMTIGFSRTVEAFLKEAARKRKFHVIVAECAPFCQ

SEQ ID NO: 848234 - protein, 204 aa, Homo sapiens
MPGSAAKGSELSERIESFVETLKRGGGPRSSEEMARETLGLLRQIITDHRWSNAGEAGLPPPANLAPVCSRSQAENFPGLTSRWLLLSSLFWTVGELMELIRREGRRMTAAQPSETTVGNMVRRVLKIIREEYGRSGSRPGLLVGSSDTFCTGPSTCSETLLELNSPCYLPDHSSPPLSLGLVASIDSMDAATRVISRSPCTNC

SEQ ID NO: 848235 - protein, 94 aa, Homo sapiens
KLAAAATVMAFPPGALHPLPKRQALEKSNGTSAVFNPSVLHYQQALTSAQLQQHAAFIPTGMCPYCPTSCALLVMCFLLISLSCLVASSLLLKV

SEQ ID NO: 848236 - protein, 255 aa, Homo sapiens
MALNVAPVRDTKWLTLEVCRQFQRGTCSRSDEECKFAHPPKSCQVENGRVIACFDSLKGRCSRENCKYLHPPTHLKTQLEINGRNNLIQQKTAAAMLAQQMQFMFPGTPLHPVPTFPVGPAIGTNTAISFAPYLAPVTPGVGLVPTEILPTTPVIVPGSPPVTVPGSTATQKLLRTDKLEVCREFQRGNCARGETDCRFAHPADSTMIDTSDNTVTVCMDYIKGRCMREKCKYFHPPAHLQAKIKAAQPRPRPQS

SEQ ID NO: 848237 - protein, 355 aa, Homo sapiens
MALNVAPVRDTKWLTLEVCRQFQRGTCSRSDEECKFAHPPKSCQVENGRVIACFDSLKGRCSRENCKYLHPPTHLKTQLEINGRNNLIQQKTAAAMLAQQMQFMFPGTPLHPVPTFPVGPAIGTNTAISFAPYLAPVTPGVGLVPTEILPTTPVIVPGSPPVTVPGSTATQKLLRTDKLEVCREFQRGNCARGETDCRFAHPADSTMIDTSDNTVTVCMDYIKGRCMREKCKYFHPPAHLQAKIKAAQHQANQAAVAAQAAAAAATVMAFPPGALHPLPKRQALEKSNGTSAVFNPSVLHYQQALTSAQLQQHAAFIPTVPMMHSATSATVSAATTPATSVPFAATATANQIILK

SEQ ID NO: 848238 - protein, 373 aa, Homo sapiens
MALNVAPVRDTKWLTLEVCRQFQRGTCSRSDEECKFAHPPKSCQVENGRVIACFDSLKGRCSRENCKYLHPPTHLKTQLEINGRNNLIQQKTAAAMLAQQMQFMFPGTPLHPVPTFPVGPAIGTNTAISFAPYLAPVTPGVGLVPTEILPTTPVIVPGSPPVTVPGSTATQKLLRTDKLEVCREFQRGNCARGETDCRFAHPADSTMIDTSDNTVTVCMDYIKGRCMREKCKYFHPPAHLQAKIKAAQHQANQAAVAAQAAAAAATVMTQSTAKAMKRPLEATVDLAFPPGALHPLPKRQALEKSNGTSAVFNPSVLHYQQALTSAQLQQHAAFIPTVPMMHSATSATVSAATTPATSVPFAATATANQIILK

SEQ ID NO: 848239 - protein, 379 aa, Homo sapiens
MALNVAPVRDTKWLTLEVCRQFQRGTCSRSDEECKFAHPPKSCQVENGRVIACFDSLKGRCSRENCKYLHPPTHLKTQLEINGRNNLIQQKTAAAMLAQQMQFMFPGTPLHPVPTFPVGPAIGTNTAISFAPYLAPVTPGVGLVPTEILPTTPVIVPGSPPVTVPGSTATQKLLRTDKLEVCREFQRGNCARGETDCRFAHPADSTMIDTSDNTVTVCMDYIKGRCMREKCKYFHPPAHLQAKIKAAQHQANQAAVAAQAAAAAATVMTQSTAKAMKRPLEATVDLAFPPGALHPLPKRQALEKSNGTSAVFNPSVLHYQQALTSAQLQQHAAFIPTDNSEIISRNGMECQESALRITKHCYCTYYPVSSSIELPQTAC

SEQ ID NO: 848240 - protein, 102 aa, Homo sapiens
KLAAAATVMAFPPGALHPLPKRQALEKSNGTSAVFNPSVLHYQQALTSAQLQQHAAFIPTDNSEIISRNGMECQESALRITKHCYCTYYPVSSSIELPQTAC

SEQ ID NO: 848241 - protein, 371 aa, Homo sapiens
MALNVAPVRDTKWLTLEVCRQFQRGTCSRSDEECKFAHPPKSCQVENGRVIACFDSLKGRCSRENCKYLHPPTHLKTQLEINGRNNLIQQKTAAAMLAQQMQFMFPGTPLHPVPTFPVGPAIGTNTAISFAPYLAPVTPGVGLVPTEILPTTPVIVPGSPPVTVPGSTATQKLLRTDKLEVCREFQRGNCARGETDCRFAHPADSTMIDTSDNTVTVCMDYIKGRCMREKCKYFHPPAHLQAKIKAAQHQANQAAVAAQAAAAAATVMTQSTAKAMKRPLEATVDLAFPPGALHPLPKRQALEKSNGTSAVFNPSVLHYQQALTSAQLQQHAAFIPTGMCPYCPTSCALLVMCFLLISLSCLVASSLLLKV

SEQ ID NO: 848242 - protein, 355 aa, Homo sapiens; identical to SEQ ID NO: 848237

SEQ ID NO: 848243 - protein, 255 aa, Homo sapiens; identical to SEQ ID NO: 848236

SEQ ID NO: 848244 - protein, 379 aa, Homo sapiens; identical to SEQ ID NO: 848239

SEQ ID NO: 848245 - protein, 373 aa, Homo sapiens
MALNVAPVRDTKWLTLEVCRQFQRGTCSRSDEECKFAHPPKSCQVENGRVIACFDSLKGRCSRENCKYLHPPTHLKTQLEINGRNNLIQQKTAAAMLAQQMQFMFPGTPLHPVPTFPVGPAIGTNTAISFAPYLAPVTPGVGLVPTEILPTTPVIVPGSPPVTVPGSTATQKLLRTDKLEVCREFQRGNCARGETDCRFAHPADSTMIDTSDNTVTVCMDYIKGRCMREKCKYFHPPAHLQAKIKAAQHQANQAAVAAQAAAAAATVMAFPPGALHPLPKRQALEKSNGTSAVFNPSVLHYQQALTSAQLQQHAAFIPTGSVLCMTPATSIDNSEIISRNGMECQESALRITKHCYCTYYPVSSSIELPQTAC

SEQ ID NO: 848246 - protein, 104 aa, Homo sapiens [sequence omitted]

SEQ ID NO: 848247 - protein, 255 aa, Homo sapiens; identical to SEQ ID NO: 848236

SEQ ID NO: 848248 - protein, 478 aa, Homo sapiens [sequence omitted]

SEQ ID NO: 848249 - protein, 348 aa, Homo sapiens
MYRQRFLYSLYRHTHWVRCAKFSPDGRLIVSCSEDKTIKIWDTTNKQCVNNFSDSVGFANFVDFNPSGTCIASAGSDQTVKVWDVRVNKLLQHYQVHSGGVNCISFHPSGNYLITASSDGTLKILDLLEGRLIYTLQGHTGPVFTVSFSKGGELFASGGADTQVLLWRTNFDELHCKGLTKRNLKRLHFDSPPHLLDIYPRTPHPHEEKVETVEINPKLEVIDLQISTPPVMDILSFDSTTTTETSGRTLPDKGEEACGYFLNPSLMSPECLPTTTKKKTEDMSDLPCESQRSIPLAVTDALEHIMEQLNVLTQTVSILEQRLTLTEDKLKDCLENQQKLFSAVQQKS

SEQ ID NO: 848250 - protein, 208 aa, Homo sapiens
MEHVSPALPVFLVSTYTLGTLCQVLLWRTNFDELHCKGLTKRNLKRLHFDSPPHLLDIYPRTPHPHEEKVETVEINPKLEVIDLQISTPPVMDILSFDSTTTTETSGRTLPDKGEEACGYFLNPSLMSPECLPTTTKKKTEDMSDLPCESQRSIPLAVTDALEHIMEQLNVLTQTVSILEQRLTLTEDKLKDCLENQQKLFSAVQQKS

SEQ ID NO: 848251 - protein, 478 aa, Homo sapiens [sequence omitted]

SEQ ID NO: 848252 - protein, 244 aa, Homo sapiens
MASATEDPVLERYFKGHKAAITSLDLSPNGKQLATASWDTFLMLWNFKPHARAYRYVGHKDVVTSVQFSPHGNLLASASRDRTVRLWIPDKRGKFSEFKAHTAPVRSVDFSADGQFLATASEDKSIKVWSMYRQRFLYSLYRHTHWVRCAKFSPDGRLIVSCSEDKTIKIWDTTNKQCVNNFSDSVGFANFVDFNPSGTCIASAGSDQTVKVWDVRVNKLLQHYQGNNFPNKKFSYRMDSFWKD

SEQ ID NO: 848253 - protein, 436 aa, Homo sapiens
MLWNFKPHARAYRYVGHKDVVTSVQFSPHGNLLASASRDRTVRLWIPDKRGKFSEFKAHTAPVRSVDFSADGQFLATASEDKSIKVWSMYRQRFLYSLYRHTHWVRCAKFSPDGRLIVSCSEDKTIKIWDTTNKQCVNNFSDSVGFANFVDFNPSGTCIASAGSDQTVKVWDVRVNKLLQHYQVHSGGVNCISFHPSGNYLITASSDGTLKILDLLEGRLIYTLQGHTGPVFTVSFSKGGELFASGGADTQVLLWRTNFDELHCKGLTKRNLKRLHFDSPPHLLDIYPRTPHPHEEKVETVEINPKLEVIDLQISTPPVMDILSFDSTTTTETSGRTLPDKGEEACGYFLNPSLMSPECLPTTTKKKTEDMSDLPCESQRSIPLAVTDALEHIMEQLNVLTQTVSILEQRLTLTEDKLKDCLENQQKLFSAVQQKS

SEQ ID NO: 848254 - protein, 485 aa, Homo sapiens
MASATEDPVLERYFKGHKAAITSLDLSPNGKQLATASWDTFLMLWNFKPHARAYRYVGHKDVVTSVQFSPHGNLLASASRDRTVRLWIPDKRGKFSEFKAHTAPVRSVDFSADGQFLATASEDKSIKVWSMYRQRFLYSLYRHTHWVRCAKFSPDGRLIVSCSEDKTIKIWDTTNKQCVNNFSDSVGFANFVDFNPSGTCIASAGSDQTVKVWDVRVNKLLQHYQVHSGGVNCISFHPSGNYLITASSDGTLKILDLLEGRLIYTLQGHTGPVFTVSFSKGGELFASGGADTQVLLWRTNFDELHCKGLTKRNLKRLHFDSPPHLLDIYPRTPHPHEEKVETVEVSFFFIFINPKLEVIDLQISTPPVMDILSFDSTTTTETSGRTLPDKGEEACGYFLNPSLMSPECLPTTTKKKTEDMSDLPCESQRSIPLAVTDALEHIMEQLNVLTQTVSILEQRLTLTEDKLKDCLENQQKLFSAVQQKS

SEQ ID NO: 848255 - protein, 223 aa, Homo sapiens
MASATEDPVLERYFKGHKAAITSLDLSPNGKQLATASWDTFLMLWNFKPHARAYRYVGHKDVVTSVQFSPHGNLLASASRDRTVRLWIPDKRGKFSEFKAHTAPVRSVDFSADGQFLATASEDKSIKVWSMYRQRFLYSLYRHTHWVRCAKDLSLLFHFQKVESYLHQEVQTHRSYYGGLTLMNCIVKVLPKEISKDYILIHHHIFLISTQEHHIPMRKKLRL

SEQ ID NO: 848256 - protein, 108 aa, Homo sapiens
MTTETSGRTLPDKGEEACGYFLNPSLMSPECLPTTTKKKTEDMSDLPCESQRSIPLAVTDALEHIMEQLNVLTQTVSILEQRLTLTEDKLKDCLENQQKLFSAVQQKS

SEQ ID NO: 848257 - protein, 347 aa, Homo sapiens
MASATEDPVLERYFKGHKAAITSLDLSPNGKQLATASWDTFLMLWNFKPHARAYRYVGHKDVVTSVQFSPHGNLLASASRDRTVRLWIPDKRGKFSEFKAHTAPVRSVDFSADGQFLATASEDKSIKVWSMYRQRFLYSLYRHTHWVRCAKFSPDGRLIVSCSEDKTIKIWDTTNKQCVNNFSDSVGFANFVDFNPSGTCIASAGSDQTVKVWDVRVNKLLQHYQVHSGGVNCISFHPSGNYLITASSDGTLKILDLLEGRLIYTLQGHTGPVFTVSFSKGGELFASGGADTQVLLWRTNFDELHCKGLTKRNLKRLHFDSPPHLLDIYPRTPHPHEEKVETVEIFY

SEQ ID NO: 848258 - protein, 213 aa, Homo sapiens
AEWTEQPVGERAVKAHRAPAPSCLKMFHQIWAALLYFYGIILNSIYQCPEHSQLTTLGVDGKEFPEVHLGQWYFIAGAAPTKEELATFDPVDNIVFNMAAGSAPMQLHLRATIRMKDGLCVPRKWIYHLTEGSTDLRTEGRPDMKTELFSSSCPGGIMLNETGQGYQRFLLYNRSPHPPEKCVEEFKSLTSCLDSKAFLLTPRNQEACELSNN

SEQ ID NO: 848259 - protein, 192 aa, Homo sapiens
ATDGHFRFPDSIWGSRSDTSGSPQVPKLYFCGARRESPQPQTFPEVHLGQWYFIAGAAPTKEELATFDPVDNIVFNMAAGSAPMQLHLRATIRMKDGLCVPRKWIYHLTEGSTDLRTEGRPDMKTELFSSSCPGGIMLNETGQGYQRFLLYNRSPHPPEKCVEEFKSLTSCLDSKAFLLTPRNQEACELSNN

SEQ ID NO: 848260 - protein, 213 aa, Homo sapiens; identical to SEQ ID NO: 848258

SEQ ID NO: 848261 - protein, 192 aa, Homo sapiens; identical to SEQ ID NO: 848259

SEQ ID NO: 848262 - protein, 226 aa, Homo sapiens
AEWTEQPVGERAVKAHRAPAPSCLKMFHQIWAALLYFYGIILNSIYQCPEHSQLTTLGVDGKEFPEVHLGQWYFIAGAAPTKEELATFDPVDNIVFNMAAGSAPMQLHLRATIRMKDGLCVPRKWIYHLTEGSTDLRTEGRPDMKTELFSSSCPGGIMLNETGQGYQRFLLYNRSPHPPEKCVEEFKSLTSCLDSKAFLLTPRNQGKVLKSHKTGLGLTKSSGVTG

SEQ ID NO: 848263 - protein, 205 aa, Homo sapiens
ATDGHFRFPDSIWGSRSDTSGSPQVPKLYFCGARRESPQPQTFPEVHLGQWYFIAGAAPTKEELATFDPVDNIVFNMAAGSAPMQLHLRATIRMKDGLCVPRKWIYHLTEGSTDLRTEGRPDMKTELFSSSCPGGIMLNETGQGYQRFLLYNRSPHPPEKCVEEFKSLTSCLDSKAFLLTPRNQGKVLKSHKTGLGLTKSSGVTG

SEQ ID NO: 848264 - protein, 213 aa, Homo sapiens; identical to SEQ ID NO: 848258

SEQ ID NO: 848265 - protein, 176 aa, Homo sapiens
QLGDKKPRLLLPKNVPQIGAALFTSIFPEVHLGQWYFIAGAAPTKEELATFDPVDNIVFNMAAGSAPMQLHLRATIRMKDGLCVPRKWIYHLTEGSTDLRTEGRPDMKTELFSSSCPGGIMLNETGQGYQRFLLYNRSPHPPEKCVEEFKSLTSCLDSKAFLLTPRNQEACELSNN

SEQ ID NO: 848266 - protein, 189 aa, Homo sapiens
AEWTEQPVGERAVKAHRAPAPSCLKMFHQIWAALLYFYGIILNSIYQCPEHSQLTTLGVDGKEFPEVHLGQWYFIAGAAPTKEELATFDPVDNIVFNMAAGSAPMQLHLRATIRMKDGLCVPRKWIYHLTEGSTDLRTEGRPDMKTELFSSSCPGGIMLNETGQGYQRFLLYNRSPHPPVLLTPRNQGL

SEQ ID NO: 848267 - protein, 1268 aa, Homo sapiens
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLEACILTQGDKISLQEPLDYLLCCIQHCLAWYKNTVIPLQQGEEEEEEEEAFYEDLDDILESITNRMIKSELEDFELDKSADFSQSTSIGIKNNISAFLVMGVCEVLIEYNFSISSFSKNRFEDILSLFMCYKKLSDILNEKAGKAKTKMANKTSDSLLSMKFVSSLLTALFRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPAKKKRKK

SEQ ID NO: 848268 - protein, 1268 aa, Homo sapiens; identical to SEQ ID NO: 848267

SEQ ID NO: 848269 - protein, 559 aa, Homo sapiens [sequence omitted]

SEQ ID NO: 848270 - protein, 517 aa, Homo sapiens
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVYQLLVLSSKGSRKSVLEGIIAFFSALDKQHNEEQSGDEYGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFAKYVASFSIIGRRCLLMLELKLSLPSPSTTCSQ

SEQ ID NO: 848271 - protein, 1268 aa, Homo sapiens; identical to SEQ ID NO: 848267

SEQ ID NO: 848272 - protein, 1314 aa, Homo sapiens
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLEACILTQGDKISLQEPLDYLLCCIQHCLAWYKNTVIPLQQGEEEEEEEEAFYEDLDDILESITNRMIKSELEDFELDKSADFSQSTSIGIKNNISAFLVMGVCEVLIEYNFSISSFSKNRFEDILSLFMCYKKLSDILNEKAGKAKTKMANKTSDSLLSMKFVSSLLTALFRSSNEFMRYAVNVALQKVQQLKETGHVSGPDGQNPEKIFQNLCDITRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPAKKKRKK

SEQ ID NO: 848273 - protein, 401 aa, Homo sapiens
RVSFPFLDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPAKKKRKK

SEQ ID NO: 848274 - protein, 1327 aa, Homo sapiens
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLEACILTQGDKISLQEPLDYLLCCIQHCLAWYKNTVIPLQQGEEEEEEEEAFYEDLDDILESITNRMIKSELEDFELDKSADFSQSTSIGIKNNISAFLVMGVCEVLIEYNFSISSFSKNRFEDILSLFMCYKKLSDILNEKAGKAKTKMANKTSDSLLSMKFVSSLLTALFRDSIQSHQESLSVLRSSNEFMRYAVNVALQKVQQLKETGHVSGPDGQNPEKIFQNLCDITRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHRGTEYILGYQGYT

SEQ ID NO: 848275 - protein, 423 aa, Homo sapiens
QERIGLHVEGKPYGKPQCAKRTQLVQLEVGISLVLLGCGFHVKITSPKEKGAQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPAKKKRKK

SEQ ID NO: 848276 - protein, 252 aa, Homo sapiens
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVYQLLVLSSKGSRKSVLEGIIAFFSALDKQHNEEQSGDE

SEQ ID NO: 848277 - protein, 299 aa, Homo sapiens [sequence omitted]

SEQ ID NO: 848278 - protein, 252 aa, Homo sapiens; identical to SEQ ID NO: 848276

SEQ ID NO: 848279 - protein, 1268 aa, Homo sapiens; identical to SEQ ID NO: 848267

SEQ ID NO: 848280 - protein, 1268 aa, Homo sapiens; identical to SEQ ID NO: 848267

SEQ ID NO: 848281 - protein, 1268 aa, Homo sapiens; identical to SEQ ID NO: 848267

SEQ ID NO: 848282 - protein, 806 aa, Homo sapiens
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLEACILTQGDKISLQEPLDYLLCCIQHCLAWYKNTVIPLQQGEEEEEEEEAFYEDLDDILESITNRMIKSELEDFELDKSADFSQSTSIGIKNNISAFLVMGVCEVLIEYNFSISSFSKNRFEDILSLFMCYKKLSDILNEKAGKAKTKMANKTSDSLCP

SEQ ID NO: 848283 - protein, 1268 aa, Homo sapiens; identical to SEQ ID NO: 848267

SEQ ID NO: 848284 - protein, 466 aa, Homo sapiens
MLGEPVFKNNTTFSCFRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPAKKKRKK

SEQ ID NO: 848285 - protein, 1329 aa, Homo sapiens
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLEACILTQGDKISLQEPLDYLLCCIQHCLAWYKNTVIPLQQGEEEEEEEEAFYEDLDDILESITNRMIKSELEDFELDKSADFSQSTSIGIKNNISAFLVMGVCEVLIEYNFSISSFSKNRFEDILSLFMCYKKLSDILNEKAGKAKTKMANKTSDSLLSMKFVSSLLTALFRDSIQSHQESLSVLRSSNEFMRYAVNVALQKVQQLKETGHVSGPDGQNPEKIFQNLCDITRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHCVTDIYSITGILKIS

SEQ ID NO: 848286 - protein, 135 aa, Homo sapiens [sequence omitted]

SEQ ID NO: 848287 - protein, 559 aa, Homo sapiens [sequence omitted]

SEQ ID NO: 848288 - protein, 107 aa, Homo sapiens
FIGQSTKSRNLFLLVSPGVSELRRNSKKYGKAGELRMPFLGMGEALLLLVTLVSFSLVVQVKLSGSHLTPLCYSFISYVQVRDSEAVPNRSSRKDFLHAQGTIDHLN

SEQ ID NO: 848289 - protein, 273 aa, Homo sapiens
YFLVVFFRDCILKKRRNIKYVMSSLNQSQATLLSIFSQEYQKHIKRTHAKHHTSEAIESYYQRYLNGVVKNGAAPVLLDLANEVDYAPSLMARLILERFLQEHEETPPSKSIINSMLRDPSQIPDGVLANQVYQCIVNDCCYGPLVDCIKHAIGHEHEVLLRDLLLEKNLSFLDEDQLRAKGYDKTPDFILQVPVAVEGHIIHWIESKASFGDECSHHAYLHDQFWSYWNRFGPGLVIYWYGFIQELDCNRERGILLKACFPTNIVTLCHSIA

SEQ ID NO: 848290 - protein, 362 aa, Homo sapiens
CTASPRRGGAGGAWDRASLRPAFAARGVFQGGLGQAKQARTRACAALPTPHPSAPRLLEPQGVFSLFPPPPGPWPNMILTKAQYDEIAQCLVSVPPTRQSLRKLKQRFPSQSQATLLSIFSQEYQKHIKRTHAKHHTSEAIESYYQRYLNGVVKNGAAPVLLDLANEVDYAPSLMARLILERFLQEHEETPPSKSIINSMLRDPSQIPDGVLANQVYQCIVNDCCYGPLVDCIKHAIGHEHEVLLRDLLLEKNLSFLDEDQLRAKGYDKTPDFILQVPVAVEGHIIHWIESKASFGDECSHHAYLHDQFWSYWNRDGISQCSSGWCGTPGLSDSSASATQSAGITGARKHFLPGIFMKCVCK

SEQ ID NO: 848291 - protein, 183 aa, Homo sapiens
MARLILERFLQEHEETPPSKSIINSMLRDPSQIPDGVLANQVYQCIVNDCCYGPLVDCIKHAIGHEHEVLLRDLLLEKNLSFLDEDQLRAKGYDKTPDFILQVPVAVEGHIIHWIESKASFGDECSHHAYLHDQFWSYWNRFGPGLVIYWYGFIQELDCNRERGILLKACFPTNIVTLCHSIA

SEQ ID NO: 848292 - protein, 357 aa, Homo sapiens
CTASPRRGGAGGAWDRASLRPAFAARGVFQGGLGQAKQARTRACAALPTPHPSAPRLLEPQGVFSLFPPPPGPWPNMILTKAQYDEIAQCLVSVPPTRQSLRKLKQRFPSQSQATLLSIFSQEYQKHIKRTHAKHHTSEAIESYYQRYLNGVVKNGAAPVLLDLANEVDYAPSLMARLILERFLQEHEETPPSKSIINSMLRDPSQIPDGVLANQVYQCIVNDCCYGPLVDCIKHAIGHEHEVLLRDLLLEKNLSFLDEDQLRAKGYDKTPDFILQVPVAVEGHIIHWIESKASFGDECSHHAYLHDQFWSYWNRFGPGLVIYWYGFIQELDCNRERGILLKACFPTNIVTLCHSIA

SEQ ID NO: 848293 - protein, 357 aa, Homo sapiens; identical to SEQ ID NO: 848292

SEQ ID NO: 848294 - protein, 352 aa, Homo sapiens
CTASPRRGGAGGAWDRASLRPAFAARGVFQGGLGQAKQARTRACAALPTPHPSAPRLLEPQGVFSLFPPPPGPWPNMILTKAQYDEIAQCLVSVPPTRQSLRKLKQRFPSQSQATLLSIFSQEYQKHIKRTHAKHHTSEAIESYYQRYLNGVVKNGAAPVLLDLANEVDYAPSLMARLILERFLQEHEETPPSKSIINSMLRDPSQIPDGVLANQVYQCIVNDCCYGPLVDCIKHAIGHEHEVLLRDLLLEKNLSFLDEDQLRAKGYDKTPDFILQVPVAVEGHIIHWIESKASFGDECSHHAYLHDQFWSYWNRFGPGLVIYWYGFIQELDCNRERGILLKACFPTNIVTF

SEQ ID NO: 848295 - protein, 203 aa, Homo sapiens
CTASPRRGGAGGAWDRASLRPAFAARGVFQGGLGQAKQARTRACAALPTPHPSAPRLLEPQGVFSLFPPPPGPWPNMILTKAQYDEIAQCLVSVPPTRQSLRKLKQRFPSQSQATLLSIFSQEYQKHIKRTHAKHHTSEAIESYYQRYLNGVVKNGAAPVLLDLANEVDYAPSLMARLILERFLQEHEETPPRPEKYYFQMQR

SEQ ID NO: 848296 - protein, 295 aa, Homo sapiens
GRVVNRHEAGPWPNMILTKAQYDEIAQCLVSVPPTRQSLRKLKQRFPSQSQATLLSIFSQEYQKHIKRTHAKHHTSEAIESYYQRYLNGVVKNGAAPVLLDLANEVDYAPSLMARLILERFLQEHEETPPSKSIINSMLRDPSQIPDGVLANQVYQCIVNDCCYGPLVDCIKHAIGHEHEVLLRDLLLEKNLSFLDEDQLRAKGYDKTPDFILQVPVAVEGHIIHWIESKASFGDECSHHAYLHDQFWSYWNRFGPGLVIYWYGFIQELDCNRERGILLKACFPTNIVTLCHSIA

SEQ ID NO: 848297 - protein, 357 aa, Homo sapiens; identical to SEQ ID NO: 848292

SEQ ID NO: 848298 - protein, 357 aa, Homo sapiens; identical to SEQ ID NO: 848292

SEQ ID NO: 848299 - protein, 357 aa, Homo sapiens; identical to SEQ ID NO: 848292

SEQ ID NO: 848300 - protein, 133 aa, Homo sapiens
CTASPRRGGAGGAWDRASLRPAFAARGVFQGGLGQAKQARTRACAALPTPHPSAPRLLEPQGVFSLFPPPPGPWPNMILTKAQYDEIAQCLVSVPPTRQSLRKLKQRFPRNTLKEHMPNIILRKQLKVITRGT

SEQ ID NO: 848301 - protein, 131 aa, Homo sapiens
GRVVNRHEAGPWPNMILTKAQYDEIAQCLVSVPPTRQSLRKLKQRFPSQSQATLLSIFSQEYQKHIKRTHAKHHTSEAIESYYQRDRPCCYLSDGLTSVAFCWKCAGQMFLSVLRDRFHRACQDGLDLLTL

SEQ ID NO: 848302 - protein, 135 aa, Homo sapiens
SPDAKGFDSVSSFGNTGGLPCELLQHLGCSRQSVSTLPNTDVETEFADAKFPHGVPRAARAESARADIAGVLAIRPDELRFRYSMVAYWRQAGLSYIRYSQICAKAVRDALKTEFKANAEKTSGSNVKIVKVKKE

SEQ ID NO: 848303 - protein, 51 aa, Homo sapiens
MVAYWRQAGLSYIRYSQICAKAVRDALKTEFKANAEKTSGSNVKIVKVKKE

SEQ ID NO: 848304 - protein, 70 aa, Homo sapiens
RPPTTTKFAAASTARLSRHCRRLGDSARRAPLSLQHGGLLETGWTQLHPILPDLCKSSERCTEDRIQSKC

SEQ ID NO: 848305 - protein, 98 aa, Homo sapiens
VRSPSAPMLGEVYSTEIKTTEVLMENFRRAIGLRIKETKEVYEGEVTELTPCEKAGLSYIRYSQICAKAVRDALKTEFKANAEKTSGSNVKIVKVKKE

SEQ ID NO: 848306 - protein, 76 aa, Homo sapiens
QTLFKLRSSALWLLDLLREPLLSRHCRRLGDSARRAPLSLQHGGLLETGWTQLHPILPDLCKSSERCTEDRIQSKC

SEQ ID NO: 848307 - protein, 70 aa, Homo sapiens; identical to SEQ ID NO: 848304

SEQ ID NO: 848308 - protein, 119 aa, Homo sapiens
MPQTKPGRQPHEPTENKEQGTRDRHRPERRNSRQPNRPRETERESAGLRVQPERGRPPEQARTDSTRQRTRLTYGQEESSTRAGVADTTGGDDQRYTAQHKTNQEHYTTELRHNKTNNQ

SEQ ID NO: 848309 - protein, 51 aa, Homo sapiens; identical to SEQ ID NO: 848303

SEQ ID NO: 848310 - protein, 76 aa, Homo sapiens; identical to SEQ ID NO: 848306

SEQ ID NO: 848311 - protein, 134 aa, Homo sapiens
QSPNSAQSPNSAQSPNSAQSPNSAQIQTVPRVQTVLRVQTVPRVQTVPRVQTVPRVQTVPRVQRADIAGVLAIRPDELRFRYSMVAYWRQAGLSYIRYSQICAKAVRDALKTEFKANAEKTSGSNVKIVKVKKE

SEQ ID NO: 848312 - protein, 135 aa, Homo sapiens; identical to SEQ ID NO: 848302

SEQ ID NO: 848313 - protein, 51 aa, Homo sapiens; identical to SEQ ID NO: 848303

SEQ ID NO: 848314 - protein, 51 aa, Homo sapiens; identical to SEQ ID NO: 848303

SEQ ID NO: 848315 - protein, 157 aa, Homo sapiens
MAKKSAENGIYSVSGDEKKGPLIAPGPDGAPAKGDGPVGLGTPGGRLAVPPRETWTRQMDFIMSCVGFAVGLGNVWRFPYLCYKNGGGVFLIPYVLIALVGGIPIFFLEISLGQFMKAGSINVWNICPLFKGEQPLASLRDCPLLPAGSHLRNLFLS

SEQ ID NO: 848316 - protein, 594 aa, Homo sapiens
GTRVSCDYKTALGLLEAEVTRDGWETEVQSKGLCPRSGEGCWDLESGVFLIPYVLIALVGGIPIFFLEISLGQFMKAGSINVWNICPLFKGLGYASMVIVFYCNTYYIMVLAWGFYYLVKSFTTTLPWATCGHTWNTPDCVEIFRHEDCANASLANLTCDQLADRRSPVIEFWENKVLRLSGGLEVPGALNWEVTLCLLACWVLVYFCVWKGVKSTGKIVYFTATFPYVVLVVLLVRGVLLPGALDGIIYYLKPDWSKLGSPQVWIDAGTQIFFSYAIGLGALTALGSYNRFNNNCYKDAIILALINSGTSFFAGFVVFSILGFMAAEQGVHISKVAESGPGLAFIAYPRAVTLMPVAPLWAALFFFMLLLLGLDSQFVGVEGFITGLLDLLPASYYFRFQREISVALCCALCFVIDLSMVTDGGMYVFQLFDYYSASGTTLLWQAFWECVVVAWVYGADRFMDDIACMIGYRPCPWMKWCWSFFTPLVCMGIFIFNVVYYEPLVYNNTYVYPWWGEAMGWAFALSSMLCVPLHLLGCLLRAKGTMAERWQHLTQPIWGLHHLEYRAQDADVRGLTTLTPVSESSKVVVVESVM

SEQ ID NO: 848317 - protein, 635 aa, Homo sapiens
MAKKSAENGIYSVSGDEKKGPLIAPGPDGAPAKGDGPVGLGTPGGRLAVPPRETWTRQMDFIMSCVGFAVGLGNVWRFPYLCYKNGGGVFLIPYVLIALVGGIPIFFLEISLGQFMKAGSINVWNICPLFKGLGYASMVIVFYCNTYYIMVLAWGFYYLVKSFTTTLPWATCGHTWNTPDCVEIFRHEDCANASLANLTCDQLADRRSPVIEFWENKVLRLSGGLEVPGALNWEVTLCLLACWVLVYFCVWKGVKSTGKIVYFTATFPYVVLVVLLVRGVLLPGALDGIIYYLKPDWSKLGSPQVWIDAGTQIFFSYAIGLGALTALGSYNRFNNNCYKDAIILALINSGTSFFAGFVVFSILGFMAAEQGVHISKVAESGPGLAFIAYPRAVTLMPVAPLWAALFFFMLLLLGLDSQFVGVEGFITGLLDLLPASYYFRFQREISVALCCALCFVIDLSMVTDGGMYVFQLFDYYSASGTTLLWQAFWECVVVAWVYGADRFMDDIACMIGYRPCPWMKWCWSFFTPLVCMGIFIFNVVYYEPLVYNNTYVYPWWGEAMGWAFALSSMLCVPLHLLGCLLRAKGTMAERWQHLTQPIWGLHHLEYRAQDADVRGLTTLTPVSESSKVVVVESVM

SEQ ID NO: 848318 - protein, 492 aa, Homo sapiens
GTEAMIKGLAWGFYYLVKSFTTTLPWATCGHTWNTPDCVEIFRHEDCANASLANLTCDQLADRRSPVIEFWENKVLRLSGGLEVPGALNWEVTLCLLACWVLVYFCVWKGVKSTGKIVYFTATFPYVVLVVLLVRGVLLPGALDGIIYYLKPDWSKLGSPQVWIDAGTQIFFSYAIGLGALTALGSYNRFNNNCYKDAIILALINSGTSFFAGFVVFSILGFMAAEQGVHISKVAESGPGLAFIAYPRAVTLMPVAPLWAALFFFMLLLLGLDSQFVGVEGFITGLLDLLPASYYFRFQREISVALCCALCFVIDLSMVTDGGMYVFQLFDYYSASGTTLLWQAFWECVVVAWVYGADRFMDDIACMIGYRPCPWMKWCWSFFTPLVCMGIFIFNVVYYEPLVYNNTYVYPWWGEAMGWAFALSSMLCVPLHLLGCLLRAKGTMAERWQHLTQPIWGLHHLEYRAQDADVRGLTTLTPVSESSKVVVVESVM

SEQ ID NO: 848319 - protein, 660 aa, Homo sapiens
GGDQTESSPKEGGGTESQAMLPTLQIQGPAAFAPGDRGPGRHCPFPVPITPTGALLPVSDSCDSLVDLVWPSVTYLALGTQSRVWPHPLGAPGQAGESPEQRRQCLELWDMASSLGDKVPRAACGKRGQTVWQLHLACLCLAQFHSPPAQPPPLSRRGGGPDPDPISRSLPGPPTPALPTHSYSSHSPRAPRLLSPLRRAPRGSPAPHRHASLQTNEAPRELPHCTWPGLPGRSLAPSFLWREPWLGGQWGPLNIPARKGDRRRWEWGCEGGGATASAEQPGPQIVYFTATFPYVVLVVLLVRGVLLPGALDGIIYYLKPDWSKLGSPQVWIDAGTQIFFSYAIGLGALTALGSYNRFNNNCYKDAIILALINSGTSFFAGFVVFSILGFMAAEQGVHISKVAESGPGLAFIAYPRAVTLMPVAPLWAALFFFMLLLLGLDSQFVGVEGFITGLLDLLPASYYFRFQREISVALCCALCFVIDLSMVTDGGMYVFQLFDYYSASGTTLLWQAFWECVVVAWVYGADRFMDDIACMIGYRPCPWMKWCWSFFTPLVCMGIFIFNVVYYEPLVYNNTYVYPWWGEAMGWAFALSSMLCVPLHLLGCLLRAKGTMAERWQHLTQPIWGLHHLEYRAQDADVRGLTTLTPVSESSKVVVVESVM

SEQ ID NO: 848320 - protein, 635 aa, Homo sapiens; identical to SEQ ID NO: 848317

SEQ ID NO: 848321 - protein, 635 aa, Homo sapiens; identical to SEQ ID NO: 848317

SEQ ID NO: 848322 - protein, 71 aa, Homo sapiens
GDPGGFSMSSSPAALAAPDPAHLGPPPLGVPSSGRRCQGPDHPDPSVREQQGRRGGECHVTTQLTSPAHLW

SEQ ID NO: 848323 - protein, 635 aa, Homo sapiens; identical to SEQ ID NO: 848317

SEQ ID NO: 848324 - protein, 635 aa, Homo sapiens; identical to SEQ ID NO: 848317

SEQ ID NO: 848325 - protein, 635 aa, Homo sapiens; identical to SEQ ID NO: 848317

SEQ ID NO: 848326 - protein, 650 aa, Homo sapiens
VCSGRLYTVCAGQPVRHVPAAFAPGDRGPGRHCPFPVPITPTGALLPVSDSCDSLVDLVWPSVTYLALGTQSRVWPHPLGAPGQAGESPEQRRQCLELWDMASSLGDKVPRAACGKRGQTVWQLHLACLCLAQFHSPPAQPPPLSRRGGGPDPDPISRSLPGPPTPALPTHSYSSHSPRAPRLLSPLRRAPRGSPAPHRHASLQTNEAPRELPHCTWPGLPGRSLAPSFLWREPWLGGQWGPLNIPARKGDRRRWEWGCEGGGAQPPLSSLAPQIVYFTATFPYVVLVVLLVRGVLLPGALDGIIYYLKPDWSKLGSPQVWIDAGTQIFFSYAIGLGALTALGSYNRFNNNCYKDAIILALINSGTSFFAGFVVFSILGFMAAEQGVHISKVAESGPGLAFIAYPRAVTLMPVAPLWAALFFFMLLLLGLDSQFVGVEGFITGLLDLLPASYYFRFQREISVALCCALCFVIDLSMVTDGGMYVFQLFDYYSASGTTLLWQAFWECVVVAWVYGADRFMDDIACMIGYRPCPWMKWCWSFFTPLVCMGIFIFNVVYYEPLVYNNTYVYPWWGEAMGWAFALSSMLCVPLHLLGCLLRAKGTMAERWQHLTQPIWGLHHLEYRAQDADVRGLTTLTPVSESSKVVVVESVM

SEQ ID NO: 848327 - protein, 751 aa, Homo sapiens
GGDQTESSPKEGGGTESQAMLPTLQIQGPAAFAPGDRGPGRHCPFPVPITPTGALLPVSDSCDSLVDLVWPSVTYLALGTQSRVWPHPLGAPGQAGESPEQRRQCLELWDMASSLGDKVPRAACGKRGQTVWQLHLACLCLAQFHSPPAQPPPLSRRGGGPDPDPISRSLPGPPTPALPTHSYSSHSPRAPRLLSPLRRAPRGSPAPHRHASLQTNEAPRELPHCTWPGLPGRSLAPSFLWREPWLGGQWGPLNIPARKGDRRRWEWGCEGGGATASAEQPGPQIVYFTATFPYVVLVVLLVRGVLLPGALDGIIYYLKPDWSKLGSPQVWIDAGTQIFFSYAIGLGALTALGSYNRFNNNCYKDAIILALINSGTSFFAGFVVFSILGFMAAEQGVHISKVAESGPGLAFIAYPRAVTLMPVAPLWAALFFFMLLLLGLDSQVCMGLWDREPGGGRREGCRQGKGWRRCGARPELPWPQFVGVEGFITGLLDLLPASYYFRFQREISVALCCALCFVIDLSMVTDVSGVGGLPVTSGGRLPSSLTGLCPQGGMYVFQLFDYYSASGTTLLWQAFWECVVVAWVYGRSWLRAGLGDGGGEGRSPAWPSRLTSPQGADRFMDDIACMIGYRPCPWMKWCWSFFTPLVCMGIFIFNVVYYEPLVYNNTYVYPWWGEAMGWAFALSSMLCVPLHLLGCLLRAKGTMAERWQHLTQPIWGLHHLEYRAQDADVRGLTTLTPVSESSKVVVVESVM

SEQ ID NO: 848328 - protein, 614 aa, Homo sapiens
MAKKSAENGIYSVSGDEKKGPLIAPGPDGAPAKGDGPVGLGTPGGRLAVPPRETWTRQMDFIMSCVGFAVGLGNVWRFPYLCYKNGGGVFLIPYVLIALVGGIPIFFLEISLGQFMKAGSINVWNICPLFKGLGYASMVIVFYCNTYYIMVLAWGFYYLVKSFTTTLPWATCGHTWNTPDCVEIFRHEDCANASLANLTCDQLADRRSPVIEFWENKVLRLSGGLEVPGALNWEVTLCLLACWVLVYFCVWKGVKSTGKIVYFTATFPYVVLVVLLVRGVLLPGALDGIIYYLKPDWSKLGSPQVWIDAGTQIFFSYAIGLGALTALGSYNRFNNNCYKDAIILALINSGTSFFAGFVVFSILGFMAAEQGVHISKVAESGPGLAFIAYPRAVTLMPVAPLWAALFFFMLLLLGLDSQFVGVEGFITGLLDLLPASYYFRFQREISVALCCALCFVIDLSMVTDGGMYVFQLFDYYSASGTTLLWQAFWECVVVAWVYGADRFMDDIACMIGYRPCPWMKWCWSFFTPLVCMGIFIFKRLCTTEPLVLQSKQPYRLVAPAVPGGWSRPTGALCAPSRPLWFPVPVALFAAWPGSLPNPFRPGRSLPPFPLPGGP

SEQ ID NO: 848329 - protein, 144 aa, Homo sapiens
AARQIWARTGAALCRQPSAAPPPAPLWVRAGFRQQLSLTLCPANEGNCGGSAPSTPGRPERAARPSVSEELTAAERQIAELHAAACAAGQLNYVDPATGYVVLTQIAHLQRGECCGSACRHCPYGQVNVKDPSKKKQFNSYFYV

SEQ ID NO: 848330 - protein, 109 aa, Homo sapiens
STGVCWRSTPDRLPGYHQRKLQNSKDCCLSLPLEVLPQRVTHQMPARALLYEAGQLNYVDPATGYVVLTQIAHLQRGECCGSACRHCPYGQVNVKDPSKKKQFNSYFYV

SEQ ID NO: 848331 - protein, 144 aa, Homo sapiens; identical to SEQ ID NO: 848329

SEQ ID NO: 848332 - protein, 123 aa, Homo sapiens
AARQIWARTGAALCRQPSAAPPPAPLWVRAGFRQQLSLTLCPANEGNCGGSAPSTPGRPERAARPSAGQLNYVDPATGYVVLTQIAHLQRGECCGSACRHCPYGQVNVKDPSKKKQFNSYFYV

SEQ ID NO: 848333 - protein, 655 aa, Homo sapiens
MGTSPSSSTALASCSRIARRATATMIAGSLLLLGFLSTTTAQPEQKASNLIGTYRHVDRATGQVLTCDKCPAGTYVSEHCTNTSLRVCSSCPVGTFTRHENGIEKCHDCSQPCPWPMIEKLPCAALTDRECTCPPGMFQSNATCAPHTVCPVGWGVRKKGTETEDVRCKQCARGTFSDVPSSVMKCKAYTDCLSQNLVVIKPGTKETDNVCGTLPSFSSSTSPSPGTAIFPRPEHMETHEVPSSTYVPKGMNSTESNSSASVRPKVLSSIQEGTVPDNTSSARGKEDVNKTLPNLQVVNHQQGPHHRHILKLLPSMEATGGEKSSTPIKGPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL

SEQ ID NO: 848334 - protein, 655 aa, Homo sapiens; identical to SEQ ID NO: 848333

SEQ ID NO: 848335 - protein, 655 aa, Homo sapiens; identical to SEQ ID NO: 848333

SEQ ID NO: 848336 - protein, 340 aa, Homo sapiens
MEATGGEKSSTPIKGPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL

SEQ ID NO: 848337 - protein, 256 aa, Homo sapiens
MMMVVLELLALFLLCSYVTSSWFLFLSLPFCFFQLGFLSTTTAQPEQKASNLIGTYRHVDRATGQVLTCDKCPAGTYVSEHCTNTSLRVCSSCPVGTFTRHENGIEKCHDCSQPCPWPMIEKLPCAALTDRECTCPPGMFQSNATCAPHTVCPVGWGVRKKGTETEDVRCKQCARGTFSDVPSSVMKCKAYTDCLSQNLVVIKPGTKETDNVCGTLPSFSSSTSPSPGTAIFPRPEHMETHEVPSSTYVPKGNLTS

SEQ ID NO: 848338 - protein, 522 aa, Homo sapiens
MCRRRANVIPKTMGKMSPGHVRGLHGSSLMEDVRCKQCARGTFSDVPSSVMKCKAYTDCLSQNLVVIKPGTKETDNVCGTLPSFSSSTSPSPGTAIFPRPEHMETHEVPSSTYVPKGMNSTESNSSASVRPKVLSSIQEGTVPDNTSSARGKEDVNKTLPNLQVVNHQQGPHHRHILKLLPSMEATGGEKSSTPIKGPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL

SEQ ID NO: 848339 - protein, 625 aa, Homo sapiens
MGTSPSSSTALASCSRIARRATATMIAGSLLLLGFLSTTTAQPEQKASNLIGTYRHVDRATGQVLTCDKCPAGTYVSEHCTNTSLRVCSSCPVGTFTRHENGIEKCHDCSQPCPWPMIEKLPCAALTDRECTCPPGMFQSNATCAPHTVCPVGWGVRKKGTETEDVRCKQCARGTFSDVPSSVMKCKAYTDCLSQNLVVIKPGTKETDNVCGTLPSFSSSTSPSPGTAIFPRPEHMETHEVPSSTYVPKGMNSTESNSSASVRPKVLSSIQEGTVPDNTSSARGKEDVNKTLPNLQVVNHQQGPHHRHILKLLPSMEATGGEKSSTPIKGPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRLLRSSSADAAHT

SEQ ID NO: 848340 - protein, 157 aa, Homo sapiens
MSGFLEGLRCSECIDWGEKRNTIASIAAGVLFFTGWWIIIDAAVIYPTMKDFNHSYHACGVIATIAFLMINAVSNGQVRGDSYSEGCLGQTGARIWLFVGFMLAFGSLIASMWILFGGYVAKEKDIVYPGIAVFFQNAFIFFGGLVFKFGRTEDLWQ

SEQ ID NO: 848341 - protein, 157 aa, Homo sapiens; identical to SEQ ID NO: 848340

SEQ ID NO: 848342 - protein, 109 aa, Homo sapiens [sequence omitted]

SEQ ID NO: 848343 - protein, 200 aa, Homo sapiens
ILGGKAQYYCFHCCWCTIFYRLVDYHRCSCYLSAPNGWTDLKKMSGFLEGLRCSECIDWGEKRNTIASIAAGVLFFTGWWIIIDAAVIYPTMKDFNHSYHACGVIATIAFLMINAVSNGQVRGDSYSEGCLGQTGARIWLFVGFMLAFGSLIASMWILFGGYVAKEKDIVYPGIAVFFQNAFIFFGGLVFKFGRTEDLWQ

SEQ ID NO: 848344 - protein, 107 aa, Homo sapiens
VNSRGQTRAGVITTIAFLMINAVSNGQVRGDSYSEGCLGQTGARIWLFVGFMLAFGSLIASMWILFGGYVAKEKDIVYPGIAVFFQNAFIFFGGLVFKFGRTEDLWQ

SEQ ID NO: 848345 - protein, 126 aa, Homo sapiens
MSGFLEGLRCSECIDWGEKRNTIASIAAGVLFFTGWWIIIDAAVIYPTMKDFNHSYHACGVIATIAFLMINAVSNGQVRGDSYSEGCLGQTEKDIVYPGIAVFFQNAFIFFGGLVFKFGRTEDLWQ

SEQ ID NO: 848346 - protein, 126 aa, Homo sapiens; identical to SEQ ID NO: 848345

SEQ ID NO: 848347 - protein, 157 aa, Homo sapiens; identical to SEQ ID NO: 848340

SEQ ID NO: 848348 - protein, 157 aa, Homo sapiens; identical to SEQ ID NO: 848340

SEQ ID NO: 848349 - protein, 212 aa, Homo sapiens
MTERGPHPPPEHPKTPGKSPDPPLQQLDKPKPREKSVTRPAPSARGAPAKGDLKKMSGFLEGLRCSECIDWGEKRNTIASIAAGVLFFTGWWIIIDAAVIYPTMKDFNHSYHACGVIATIAFLMINAVSNGQVRGDSYSEGCLGQTGARIWLFVGFMLAFGSLIASMWILFGGYVAKEKDIVYPGIAVFFQNAFIFFGGLVFKFGRTEDLWQ

SEQ ID NO: 848350 - protein, 140 aa, Homo sapiens
MSGFLEGLRCSECIDWGEKRNTIASIAAGVLFFTGWWIIIDAAVIYPTMKDFNHSYHACGVIATIAFLMINAVSNGQVRGDSYSEGCLGQTGARIWLFVGFMLAFGSLIASMWILFGGYVAKEGWFLSLAALKTYGSEHI

SEQ ID NO: 848351 - protein, 157 aa, Homo sapiens; identical to SEQ ID NO: 848340

SEQ ID NO: 848352 - protein, 167 aa, Homo sapiens
KRKKEQAMEGNRDEAEKCVEIAREALNAGNREKAQRFLQKAEKLYPLPSARALLEIIMKNGSTAGNSPHCRKPSGSGDQSKPNCTKDSTSGSGEGGKGYTKDQVDGVLSINKCKNYYEVLGVTKDAGDEDLKKAYRKLALKFHPDKNHAPGATDAFKSKVNLLKQFY

SEQ ID NO: 848353 - protein, 386 aa, Homo sapiens
KRKKEQAMEGNRDEAEKCVEIAREALNAGNREKAQRFLQKAEKLYPLPSARALLEIIMKNGSTAGNSPHCRKPSGSGDQSKPNCTKDSTSGSGEGGKGYTKDQVDGVLSINKCKNYYEVLGVTKDAGDEDLKKAYRKLALKFHPDKNHAPGATDAFKKIGNAYAVLSNPEKRKQYDLTGNEEQACNHQNNGRFNFHRGCEADITPEDLFNIFFGGGFPSGSVHSFSNGRAGYSQQHQHRHSGHEREEERGDGGFSVFIQLMPIIVLILVSLLSQLMVSNPPYSLYPRSGTGQTIKMQTENLGVVYYVNKDFKNEYKGMLLQKVEKSVEEDYVTNIRNNCWKERQQKTDMQYAAKVYRDDRLRRKADALSMDNCKELERLTSLYKGG

SEQ ID NO: 848354 - protein, 386 aa, Homo sapiens; identical to SEQ ID NO: 848353

SEQ ID NO: 848355 - protein, 386 aa, Homo sapiens; identical to SEQ ID NO: 848353

SEQ ID NO: 848356 - protein, 116 aa, Homo sapiens
KRKKEQAMEGNRDEAEKCVEIAREALNAGNREKAQRFLQKAEKLYPLPSARALLEIIMKNGSTAGNSPHCRKPSGSGDQSKPNCTKDSTSGSGEGGKGYTKDQVDGVLRALWILEH

SEQ ID NO: 848357 - protein, 386 aa, Homo sapiens; identical to SEQ ID NO: 848353

SEQ ID NO: 848358 - protein, 386 aa, Homo sapiens; identical to SEQ ID NO: 848353

SEQ ID NO: 848359 - protein, 386 aa, Homo sapiens; identical to SEQ ID NO: 848353

SEQ ID NO: 848360 - protein, 143 aa, Homo sapiens
MMQICDTYNQKHSLFNAMNRFIGAVNNMDQTVMVPSLLRDVPLADPGLDNDVGVEVGGSGGCLEERTPPVPDSGSANGSFFAPSRDMYSHYVLLKSIRNDIEWGVLHQPPPPAGSEEGSAEIKASVTGIEVRAQKLTSSLALN

SEQ ID NO: 848361 - protein, 182 aa, Homo sapiens
MQICDTYNQKHSLFNAMNRFIGAVNNMDQTVMVPSLLRDVPLADPGLDNDVGVEVGGSGGCLEERTPPVPDSGSANGSFFAPSRDMYSHYVLLKSIRNDIEWGVLHQPPPPAGSEEGSAWKSKDILVDLGHLEGADAGEEDLEQQFHYHLRGLHTVLSKLTRKANILTNRYKQEIGFGNWGH

SEQ ID NO: 848362 - protein, 182 aa, Homo sapiens; identical to SEQ ID NO: 848361

SEQ ID NO: 848363 - protein, 182 aa, Homo sapiens; identical to SEQ ID NO: 848361

SEQ ID NO: 848364 - protein, 182 aa, Homo sapiens; identical to SEQ ID NO: 848361

SEQ ID NO: 848365 - protein, 141 aa, Homo sapiens
GLLWLLTDSEVAKPPSLARTCVRSCRSGRDIPTLHLGRGTVSRLDVTVVCLYRSIRNDIEWGVLHQPPPPAGSEEGSAWKSKDILVDLGHLEGADAGEEDLEQQFHYHLRGLHTVLSKLTRKANILTNRYKQEIGFGNWGH

SEQ ID NO: 848366 - protein, 404 aa, Homo sapiens
MAAVPELLQQQEEDRSKLRSVSVDLNVDPSLQIDIPDALSERDKVKFTVHTKTTLPTFQSPEFSVTRQHEDFVWLHDTLIETTDYAGLIIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKYLLKVAELFEKLRKVEGRVSSDEDLKLTELLRYYMLNIEAAKDLLYRRTKALIDYENSNKALDKARLKSKDVKLAEAHQQECCQKFEQLSESAKEELINFKRKRVAAFRKNLIEMSELEIKHARNNVSLLQSCIDLFKNN

SEQ ID NO: 848367 - protein, 224 aa, Homo sapiens
PRQSFPRKDCIGQQQEEDRSKLRSVSVDLNVDPSLQIDIPDALSERDKVKFTVHTKTTLPTFQSPEFSVTRQHEDFVWLHDTLIETTDYAGLIIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKVSDLWLLEKIFYFIGNR

SEQ ID NO: 848368 - protein, 404 aa, Homo sapiens; identical to SEQ ID NO: 848366

SEQ ID NO: 848369 - protein, 299 aa, Homo sapiens
MQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKYLLKVAELFEKLRKVEGRVSSDEDLKLTELLRYYMLNIEAAKDLLYRRTKALIDYENSNKALDKARLKSKDVKLAEAHQQECCQKFEQLSESAKEELINFKRKRVAAFRKNLIEMSELEIKHARNNVSLLQSCIDLFKNN

SEQ ID NO: 848370 - protein, 372 aa, Homo sapiens
MAAVPELLQQQEEDRSKLRSVSVDLNVDPSLQIDIPDALSERDKVKFTVHTKTTLPTFQSPEFSVTRQHEDFVWLHDTLIETTDYAGLIIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKYLLKVAELFEKLRKVEGRVSSDEDLKLTELLRYYMLNIEAAKDLLYRRTKALIDYENSNKALDKARLKSKDVKLAEAHQQECCQKFEQLSESAKEGVQLKILPVSEIM

SEQ ID NO: 848371 - protein, 369 aa, Homo sapiens
MAAVPELLQQQEEDRSKTTLPTFQSPEFSVTRQHEDFVWLHDTLIETTDYAGLIIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKYLLKVAELFEKLRKVEGRVSSDEDLKLTELLRYYMLNIEAAKDLLYRRTKALIDYENSNKALDKARLKSKDVKLAEAHQQECCQKFEQLSESAKEELINFKRKRVAAFRKNLIEMSELEIKHARNNVSLLQSCIDLFKNN

SEQ ID NO: 848372 - protein, 404 aa, Homo sapiens; identical to SEQ ID NO: 848366

SEQ ID NO: 848373 - protein, 404 aa, Homo sapiens; identical to SEQ ID NO: 848366

SEQ ID NO: 848374 - protein, 397 aa, Homo sapiens
MAAVPELLQQQEEDRSKLRSVSVDLNVDPSLQIDIPDALSERDKVKFTVHTKTTLPTFQSPEFSVTRQHEDFVWLHDTLIETTDYAGLIIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKYLLKVAELFEKLRKVEGRVSSDEDLKLTELLRYYMLNIEAAKDLLYRRTKALIDYENSNKALDKARLKSKDVKLAEAHQQECCQKFEQLSESAKEELINFKRKRVAAFRKNLIEMSELEIKHARSCIDLFKNN

SEQ ID NO: 848375 - protein, 360 aa, Homo sapiens
MAAVPELLQQQEEDRSKLRSVSVDLNVDPSLQIDIPDALSERDKVKFTVHTKTTLPTFQSPEFSVTRQHEDFVWLHDTLIETTDYAGLIIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKYLLKVAELFEKLRKVEGRVSSDEDLKLTELLRYYMLNIEAAKDLLYRRTKALIDYENSNKALDKARLKSKDVKLAEAHQQECCQKFEQLSESAKEG

SEQ ID NO: 848376 - protein, 368 aa, Homo sapiens
MAAVPELLQQQEEDRSKLRSVSVDLNVDPSLQIDIPDALSERDKVKFTVHTKTTLPTFQSPEFSVTRQHEDFVWLHDTLIETTDYAGLIIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKYLLKVAELFEKLRKVEGRVSSDEDLKLTELLRYYMLNIEAAKDLLYRRTKALIDYENSNKALDKARLKSKDVKLAEAHQQECCQKFEHFGFERRLINSTERVED

SEQ ID NO: 848377 - protein, 436 aa, Homo sapiens
MAAVPELLQQQEEDRSKLRSVSVDLNVDPSLQIDIPDALSERDKVKFTVHTKTTLPTFQSPEFSVTRQHEDFVWLHDTLIETTDYAGLIIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKVPIGRLVAAYLKNLRTVRGSSFHHNDALQVKEGPSDTTWFNIESRARSPYIQTPTQARERIGNPTQEPGGKEPPGKEDTDDVNRVVVGSTPPEEGGLPTHVMTRLPATAAPKRTLFNQRTSERAPPNNMTASQGGATKRRAGRHPGTDDMVAHNDLFPTTEKQSGSTAIDLT

SEQ ID NO: 848378 - protein, 126 aa, Homo sapiens
MAAVPELLQQQEEDRSKVRSSQPQTPGRAALRAPGSLHSFPCASIGRGCSPPSPAREAPVRPGRPLSLVFTEGCPGESLWMSRILLGQNQRRGTLAPAQAPVPSGLGEMISGDPGMFFLKLSSASW

SEQ ID NO: 848379 - protein, 126 aa, Homo sapiens; identical to SEQ ID NO: 848378

SEQ ID NO: 848380 - protein, 73 aa, Homo sapiens
YPPPPTKNGNFLCFNLIEKNGVVNCENAEDRGRSQFGRVDEHAELESLQSSKRCRLEASGDESGSQRPLFWGA

SEQ ID NO: 848381 - protein, 299 aa, Homo sapiens; identical to SEQ ID NO: 848369

SEQ ID NO: 848382 - protein, 299 aa, Homo sapiens; identical to SEQ ID NO: 848369

SEQ ID NO: 848383 - protein, 441 aa, Homo sapiens
MAAVPELLQQQEEDRSKLRSVSVDLNVDPSLQIDIPDALSERDKVKFTVHTKTTLPTFQSPEFSVTRQHEDFVWLHDTLIETTDYAGLIPQEWSGCLLWTSKSRMRHQLENIAAGTRGSWFLPLLQIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKYLLKVAELFEKLRKVEGRVSSDEDLKLTELLRYYMLNIEAAKDLLYRRTKALIDYENSNKALDKARLKSKDVKLAEAHQQECCQKFEQLSESAKEELINFKRKRVAAFRKNLIEMSELEIKHARNNVSLLQSCIDLFKNN

SEQ ID NO: 848384 - protein, 299 aa, Homo sapiens; identical to SEQ ID NO: 848369

SEQ ID NO: 848385 - protein, 299 aa, Homo sapiens; identical to SEQ ID NO: 848369

SEQ ID NO: 848386 - protein, 397 aa, Homo sapiens; identical to SEQ ID NO: 848374

SEQ ID NO: 848387 - protein, 368 aa, Homo sapiens
MAAVPELLQQQEEDRSKLRSVSVDLNVDPSLQIDIPDALSERDKVKFTVHTKTTLPTFQSPEFSVTRQHEDFVWLHDTLIETTDYAGLIIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKYLLKVAELFEKLRKVEGRVSSDEDLKLTELLRYYMLNIEAAKDLLYRRTKALIDYENSNKALDKARLKSKDVKLAEAHQQECCQKFEQLSESAKEGVQLKILPN

SEQ ID NO: 848388 - protein, 367 aa, Homo sapiens
MAAVPELLQQQEEDRSKLRSVSVDLNVDPSLQIDIPDALSERDKVKFTVHTKIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKYLLKVAELFEKLRKVEGRVSSDEDLKLTELLRYYMLNIEAAKDLLYRRTKALIDYENSNKALDKARLKSKDVKLAEAHQQECCQKFEQLSESAKEELINFKRKRVAAFRKNLIEMSELEIKHARNNVSLLQSCIDLFKNN

SEQ ID NO: 848389 - protein, 404 aa, Homo sapiens; identical to SEQ ID NO: 848366

SEQ ID NO: 848390 - protein, 404 aa, Homo sapiens; identical to SEQ ID NO: 848366

SEQ ID NO: 848391 - protein, 372 aa, Homo sapiens; identical to SEQ ID NO: 848370

SEQ ID NO: 848392 - protein, 372 aa, Homo sapiens; identical to SEQ ID NO: 848370

SEQ ID NO: 848393 - protein, 290 aa, Homo sapiens
MAAVPELLQQQEEDRSKLRSVSVDLNVDPSLQIDIPDALSERDKVKFTVHTKTTLPTFQSPEFSVTRQHEDFVWLHDTLIETTDYAGLIIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKYLLKVAELFEKLRVRISVLVFIIYIL

SEQ ID NO: 848394 - protein, 220 aa, Homo sapiens
MAAVPELLQQQEEDRSKLRSVSVDLNVDPSLQIDIPDALSERDKVKFTVHTKTTLPTFQSPEFSVTRQHEDFVWLHDTLIETTDYAGLIIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKVSDLWLLEKIFYFIGNR

SEQ ID NO: 848395 - protein, 245 aa, Homo sapiens
RPRSRCRPPAPAVMLRAALPALLLPLLGLAAAAVADCPSSTWIQFQDSCYIFLQEAIKVESIEDVRNQCTDHGADMISIHNEEENAFILDTLKKQWKGPDDILLGMFYDTDDASFKWFDNSNMTFDKWTDQDDDEDLVDTCAFLHIKTGEWKKGNCEVSSVEGTLCKTAIPYKRKYLSDNHILISALVIASTVILTVLGAIIWFLYKKHSDSRFTTVFSTAPQSPYNEDCVLVVGEENEYPVQFD

SEQ ID NO: 848396 - protein, 245 aa, Homo sapiens; identical to SEQ ID NO: 848395

SEQ ID NO: 848397 - protein, 245 aa, Homo sapiens; identical to SEQ ID NO: 848395

SEQ ID NO: 848398 - protein, 245 aa, Homo sapiens; identical to SEQ ID NO: 848395

SEQ ID NO: 848399 - protein, 245 aa, Homo sapiens; identical to SEQ ID NO: 848395

SEQ ID NO: 848400 - protein, 257 aa, Homo sapiens
RPRSRCRPPAPAVMLRAALPALLLPLLGLAAAAVADCPSSTWIQFQDSCYIFLQEAIKVESIEDVRNQCTDHGADMISIHNEEENAFILDTLKKQWKGPDDILLGMFYDTDDASFKWFDNSNMTFDKWTDQDDDEDLVDTCAFLHIKTGVLTNGQGAVYLDEGALCPIRLPGHLRRLSAPPLLLLPTIFIIFLPFTFLFLPFLPLASLSPFPILSFPLIMYVVLIVTRALARRWRARLAVHVIRDFTFVLPVCLTNS

SEQ ID NO: 848401 - protein, 157 aa, Homo sapiens
RPRSRCRPPAPAVMLRAALPALLLPLLGLAAAAVAGKPLRSPSPGPCATAFAPFPTHALRPRAPEGGPQTQHPAGHPALPCTPVPRGSWLRVTSHPPALGEGRWPRIREGSVFLGVHILTADPTPRGGNPQIRPVGRRTEGLGVARRAPFQGNFGLK

SEQ ID NO: 848402 - protein, 245 aa, Homo sapiens; identical to SEQ ID NO: 848395

SEQ ID NO: 848403 - protein, 1218 aa, Homo sapiens
MSWSPDQELVLLATGQQTLIMMTKDFEPILEQQIHQDDFGESKFITVGWGRKETQFHGSEGRQAAFQMQMHESALPWDDHRPQVTWRGDGQFFAVSVVCPETGARKVRVWNREFALQSTSEPVAGLGPALAWKPSGSLIASTQDKPNQQDIVFFEKNGLLHGHFTLPFLKDEVKVNDLLWNADSSVLAVWLEDLQREESSIPKTCVQLWTVGNYHWYLKQSLSFSTCGKSKIVSLMWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKLMFKEAFECMRKLRINLNLIYDHNPKVFLGNVETFIKQIDSVNHINLFFTELKEEDVTKTMYPAPVTSSVYLSRDPDGNKIDLVCDAMRAVMESINPHKYCLSILTSHVKKTTPELEIVLQKVHELQGNAPSDPDAVSAEEALKYLLHLVDVNELYDHSLGTYDFDLVLMVAEKSQKDPKEYLPFLNTLKKMETNYQRFTIDKYLKRYEKAIGHLSKCGPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAGKLVEQRKHIDAAMVLEECAQDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPVLGPNSTANSIMASYQQQKTSVPVLDAELFIPPKINRRTQWKLSLLD

SEQ ID NO: 848404 - protein, 615 aa, Homo sapiens
MRHHIEPWYSSDTEVVDQLMFKEAFECMRKLRINLNLIYDHNPKVFLGNVETFIKQIDSVNHINLFFTELKEEDVTKTMYPAPVTSSVYLSRDPDGNKIDLVCDAMRAVMESINPHKYCLSILTSHVKKTTPELEIVLQKVHELQGNAPSDPDAVSAEEALKYLLHLVDVNELYDHSLGTYDFDLVLMVAEKSQKDPKEYLPFLNTLKKMETNYQRFTIDKYLKRYEKAIGHLSKCGPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAGKLVEQRKHIDAAMVLEECAQDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPVLGPNSTANSIMASYQQQKTSVPVLDAELFIPPKINRRTQWKLSLLD

SEQ ID NO: 848405 - protein, 983 aa, Homo sapiens
MRNLKLFRTLEFRDIQGPGNPQCFSLRTEQGTVLIGSEHGLIEVDPVSREVKNEVSLVAEGFLPEDGSGRIVGVQDLLDQESVCVATASGDVILCSLSTQQLECVGSVASGISVMSWSPDQELVLLATGQQTLIMMTKDFEPILEQQIHQDDFGESKFITVGWGRKETQFHGSEGRQAAFQMQMHESALPWDDHRPQVTWRGDGQFFAVSVVCPETGARKVRVWNREFALQSTSEPVAGLGPALAWKPSGSLIASTQDKPNQQDIVFFEKNGLLHGHFTLPFLKDEVKVNDLLWNADSSVLAVWLEDLQREESSIPKTCVQLWTVGNYHWYLKQSLSFSTCGKSKIVSLMWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKLMFKEAFECMRKLRINLNLIYDHNPKVFLGNVETFIKQIDSVNHINLFFTELKEEDVTKTMYPAPVTSSVYLSRDPDGNKIDLVCDAMRAVMESINPHKYCLSILTSHVKKTTPELEIVLQKVHELQGNAPSDPDAVSAEEALKYLLHLVDVNELYDHSLGTYDFDLVLMVAEKSQKDPKEYLPFLNTLKKMETNYQRFTIDKYLKRYEKAIGHLSKCGPEYFPECLNLIKDRYQHCLWGAPDAGAHV

SEQ ID NO: 848406 - protein, 369 aa, Homo sapiens
EYFRASLYKFLSFIKFKHSGKVLDISIAYGEHLMQEHMYEPAGLMFARCGAHEKALSAFLTCGNWKQALCVAAQLNFTKDQLVGLGRTLAGKLVEQRKHIDAAMVLEECAQDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPVLGPNSTANSIMASYQQQKTSVPVLDAELFIPPKINRRTQWKLSLLD

SEQ ID NO: 848407 - protein, 212 aa, Homo sapiens [sequence omitted]

SEQ ID NO: 848408 - protein, 266 aa, Homo sapiens [sequence omitted]

SEQ ID NO: 848409 - protein, 212 aa, Homo sapiens [sequence omitted]

SEQ ID NO: 848410 - protein, 155 aa, Homo sapiens
MSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPVLGPNSTANSIMASYQQQKTSVPVLDAELFIPPKINRRTQWKLSLLD

SEQ ID NO: 848411 - protein, 1299 aa, Homo sapiens
MRNLKLFRTLEFRDIQGPGNPQCFSLRTEQGTVLIGSEHGLIEVDPVSREVKNEVSLVAEGFLPEDGSGRIVGVQDLLDQESVCVATASGDVILCSLSTQQLECVGSVASGISVMSWSPDQELVLLATGQQTLIMMTKDFEPILEQQIHQDDFGESKFITVGWGRKETQFHGSEGRQAAFQMQMHESALPWDDHRPQVTWRGDGQFFAVSVVCPETGARKVRVWNREFALQSTSEPVAGLGPALAWKPSGSLIASTQDKPNQQDIVFFEKNGLLHGHFTLPFLKDEVKVNDLLWNADSSVLAVWLEDLQREESSIPKTCVQLWTVGNYHWYLKQSLSFSTCGKSKIVSLMWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKLMFKEAFECMRKLRINLNLIYDHNPKVFLGNVETFIKQIDSVNHINLFFTELKEEDVTKTMYPAPVTSSVYLSRDPDGNKIDLVCDAMRAVMESINPHKYCLSILTSHVKKTTPELEIVLQKVHELQGNAPSDPDAVSAEEALKYLLHLVDVNELYDHSLGTYDFDLVLMVAEKSQKDPKEYLPFLNTLKKMETNYQRFTIDKYLKRYEKAIGHLSKCGPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAGKLVEQRKHIDAAMVLEECAQDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPTWGEGVLLCCPSWS

SEQ ID NO: 848412 - protein, 1332 aa, Homo sapiens
MRNLKLFRTLEFRDIQGPGNPQCFSLRTEQGTVLIGSEHGLIEVDPVSREVKNEVSLVAEGFLPEDGSGRIVGVQDLLDQESVCVATASGDVILCSLSTQQLECVGSVASGISVMSWSPDQELVLLATGQQTLIMMTKDFEPILEQQIHQDDFGESKFITVGWGRKETQFHGSEGRQAAFQMQMHESALPWDDHRPQVTWRGDGQFFAVSVVCPETGARKVRVWNREFALQSTSEPVAGLGPALAWKPSGSLIASTQDKPNQQDIVFFEKNGLLHGHFTLPFLKDEVKVNDLLWNADSSVLAVWLEDLQREESSIPKTCVQLWTVGNYHWYLKQSLSFSTCGKSKIVSLMWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKLMFKEAFECMRKLRINLNLIYDHNPKVFLGNVETFIKQIDSVNHINLFFTELKEEDVTKTMYPAPVTSSVYLSRDPDGNKIDLVCDAMRAVMESINPHKYCLSILTSHVKKTTPELEIVLQKVHELQGNAPSDPDAVSAEEALKYLLHLVDVNELYDHSLGTYDFDLVLMVAEKSQKDPKEYLPFLNTLKKMETNYQRFTIDKYLKRYEKAIGHLSKCGPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAGKLVEQRKHIDAAMVLEECAQDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPVLGPNSTANSIMASYQQQKTSVPVLDAELFIPPKINRRTQWKLSLLD

SEQ ID NO: 848413 - protein, 114 aa, Homo sapiens
MAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKV

SEQ ID NO: 848414 - protein, 788 aa, Homo sapiens
MRNLKLFRTLEFRDIQGPGNPQCFSLRTEQGTVLIGSEHGLIEVDPVSREVKNEVSLVAEGFLPEDGSGRIVGVQDLLDQESVCVATASGDVILCSLSTQQLECVGSVASGISVMSWSPDQELVLLATGQQTLIMMTKDFEPILEQQIHQDDFGESKFITVGWGRKETQFHGSEGRQAAFQMQMHESALPWDDHRPQVTWRGDGQFFAVSVVCPETGARKVRVWNREFALQSTSEPVAGLGPALAWKPSGSLIASTQDKPNQQDIVFFEKNGLLHGHFTLPFLKDEVKVNDLLWNADSSVLAVWLEDLQREESSIPKTCVQLWTVGNYHWYLKQSLSFSTCGKSKIVSLMWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKLMFKEAFECMRKLRINLNLIYDHNPKVFLGNVETFIKQIDSVNHINLFFTELK

SEQ ID NO: 848415 - protein, 1332 aa, Homo sapiens; identical to SEQ ID NO: 848412

SEQ ID NO: 848416 - protein, 1332 aa, Homo sapiens; identical to SEQ ID NO: 848412

SEQ ID NO: 848417 - protein, 356 aa, Homo sapiens
EYFRASLYKFLSFIKFKHSGKVLDISIAYGEHLMQEHMYEPAGLMFARCGAHEKALSAFLTCGNWKQALCVAAQLNFTKDQLVGLGRTLAGKLVEQRKHIDAAMVLEECAQDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKVGDEGIPIFYTGTPSLSRVRWNQGRAIHRQGLLAEILPGKFGWARVPFPETLSGALLSYPRQKFQVTPGDTRGPNSIRALCIDGES

SEQ ID NO: 848418 - protein, 1371 aa, Homo sapiens
MRNLKLFRTLEFRDIQGPGNPQCFSLRTEQGTVLIGSEHGLIEVDPVSREVKNEVSLVAEGFLPEDGSGRIVGVQDLLDQESVCVATASGDVILCSLSTQQLECVGSVASGISVMSWSPDQELVLLATGQQTLIMMTKDFEPILEQQIHQDDFGESKFITVGWGRKETQFHGSEGRQAAFQMQMHESALPWDDHRPQVTWRGDGQFFAVSVVCPETGARKVRVWNREFALQSTSEPVAGLGPALAWKPSGSLIASTQDKPNQQDIVFFEKNGLLHGHFTLPFLKDEVKVNDLLWNADSSVLAVWLEDLQREESSIPKTCVQLWTVGNYHWYLKQSLSFSTCGKSKIVSLMWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKLMFKEAFECMRKLRINLNLIYDHNPKVFLGNVETFIKQIDSVNHINLFFTELKEEDVTKTMYPAPVTSSVYLSRDPDGNKIDLVCDAMRAVMESINPHKYCLSILTSHVKKTTPELEIVLQKVHELQGNAPSDPDAVSAEEALKYLLHLVDVNELYDHSLGTYDFDLVLMVAEKSQKDPKEYLPFLNTLKKMETNYQRFTIDKYLKRYEKAIGHLSKCGPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAGKLVEQRKHIDAAMVLEECAQRWGVTSCPRWSETPGLKWSLHLCLPKCWDSMCKPLCLTKDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPVLGPNSTANSIMASYQQQKTSVPVLDAELFIPPKINRRTQWKLSLLD

SEQ ID NO: 848419 - protein, 1234 aa, Homo sapiens
MRNLKLFRTLEFRDIQGPGNPQCFSLRTEQGTVLIGSEHGLIEVDPVSREVKNEVSLVAEGFLPEDGSGRIVGVQDLLDQESVCVATASGDVILCSLSTQQLECVGSVASGISVMSWSPDQELVLLATGQQTLIMMTKDFEPILEQQIHQDDFGESKFITVGWGRKETQFHGSEGRQAAFQMQMHESALPWDDHRPQVTWRGDGQFFAVSVVCPETGARKVRVWNREFALQSTSEPVAGLGPALAWKPSGSLIASTQDKPNQQDIVFFEKNGLLHGHFTLPFLKDEVKVNDLLWNADSSVLAVWLEDLQREESSIPKTCVQLWTVGNYHWYLKQSLSFSTCGKSKIVSLMWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKLMFKEAFECMRKLRINLNLIYDHNPKVFLGNVETFIKQIDSVNHINLFFTELKEEDVTKTMYPAPVTSSVYLSRDPDGNKIDLVCDAMRAVMESINPHKYCLSILTSHVKKTTPELEIVLQKVHELQGNAPSDPDAVSAEEALKYLLHLVDVNELYDHSLGTYDFDLVLMVAEKSQKDPKEYLPFLNTLKKMETNYQRFTIDKYLKRYEKAIGHLSKCGPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAGKLVEQRKHIDAAMVLEECAQDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKV

SEQ ID NO: 848420 - protein, 1332 aa, Homo sapiens; identical to SEQ ID NO: 848412

SEQ ID NO: 848421 - protein, 639 aa, Homo sapiens
MEDSQDLNEQSVKKTCTESDVSQSQNSRSMEMQDLASPHTLVGGGDTPGSSKLEKSNLSSTSVTTNGTGGENMTVLNIADWLLSCNTPSSATMSLLAVKTEPLNSSETTATTGDGALDTFTGSVITSSGYSPRSAHQYSPQLYPSKPYPHILSTPAAQTMSAYAGQTQYSGMQQPAVYTAYSQTGQPYSLPTYDLGVMLPAIKTESGLSQTQSPLQSGCLSYSPGFSTPQPGQTPYSYQMPGSSFAPSSTIYANNSVSNSTNFSGSQQDYPSYTAFGQNQYAQYYSASTYGAYMTSNNTADGTPSSTSTYQLQESLPGLTNQPGEFDTMQSPSTPIKDLDERTCRSSGSKSRGRGRKNNPSPPPDSDLERVFVWDLDETIIVFHSLLTGSYAQKYGKDPPMAVTLGLRMEEMIFNLADTHLFFNDLEECDQVHIDDVSSDDNGQDLSTYSFATDGFHAAASSANLCLPTGVRGGVDWMRKLAFRYRRVKELYNTYKNNVGGLLGPAKRDAWLQLRAEIEGLTDSWLTNALKSLSIISTRSNCINVLVTTTQLIPALAKVLLYSLGGAFPIENIYSATKIGKESCFERIMQRFGRKVVYVVIGDGVEEEQAAKKHNMPFWRISSHSDLLALHQALELEYL

SEQ ID NO: 848422 - protein, 143 aa, Homo sapiens
SCPREVVAALERGKELREKPGSDDCGGWARSLIFFSSPFPPVAVRSFGSSSFPPPPRSRLLPPPRFSPACVRYLLWGGRRGCPVFTRGTARRGNFDTGRNENKYLITDALNRGWDRHFGNPRRTGRRGKCKNTGHSVKTGPSL

SEQ ID NO: 848423 - protein, 486 aa, Homo sapiens
MSAYAGQTQYSGMQQPAVYTAYSQTGQPYSLPTYDLGVMLPAIKTESGLSQTQSPLQSGCLSYSPGFSTPQPGQTPYSYQMPGSSFAPSSTIYANNSVSNSTNFSGSQQDYPSYTAFGQNQYAQYYSASTYGAYMTSNNTADGTPSSTSTYQLQESLPGLTNQPGTDLHPGEFDTMQSPSTPIKDLDERTCRSSGSKSRGRGRKNNPSPPPDSDLERVFVWDLDETIIVFHSLLTGSYAQKYGKDPPMAVTLGLRMEEMIFNLADTHLFFNDLEECDQVHIDDVSSDDNGQDLSTYSFATDGFHAAASSANLCLPTGVRGGVDWMRKLAFRYRRVKELYNTYKNNVGGLLGPAKRDAWLQLRAEIEGLTDSWLTNALKSLSIISTRSNCINVLVTTTQLIPALAKVLLYSLGGAFPIENIYSATKIGKESCFERIMQRFGRKVVYVVIGDGVEEEQAAKKHNMPFWRISSHSDLLALHQALELEYL

SEQ ID NO: 848424 - protein, 410 aa, Homo sapiens
MFFTMLGSSFAPSSTIYANNSVSNSTNFSGSQQDYPSYTAFGQNQYAQYYSASTYGAYMTSNNTADGTPSSTSTYQLQESLPGLTNQPGTDLHPGEFDTMQSPSTPIKDLDERTCRSSGSKSRGRGRKNNPSPPPDSDLERVFVWDLDETIIVFHSLLTGSYAQKYGKDPPMAVTLGLRMEEMIFNLADTHLFFNDLEECDQVHIDDVSSDDNGQDLSTYSFATDGFHAAASSANLCLPTGVRGGVDWMRKLAFRYRRVKELYNTYKNNVGGLLGPAKRDAWLQLRAEIEGLTDSWLTNALKSLSIISTRSNCINVLVTTTQLIPALAKVLLYSLGGAFPIENIYSATKIGKESCFERIMQRFGRKVVYVVIGDGVEEEQAAKKHNMPFWRISSHSDLLALHQALELEYL

SEQ ID NO: 848425 - protein, 583 aa, Homo sapiens
MEMQDLASPHTLVGGGDTPGSSKLEKSNLSSTSVTTNGTGVSLLAVKTEPLNSSETTATTGDGALDTFTGSVITSSGYSPRSAHQYSPQLYPSNSSNNVCLCRPDSVFGDAAASRLHSLLTDRTALQLAHLRFGCDVASHQDREWTFPNSVPITEWLPQLQPRVLYPTARPDTLFLPKPGSSFAPSSTIYANNSVSNSTNFSGSQQDYPSYTAFGQNQYAQYYSASTYGAYMTSNNTADGTPSSTSTYQLQESLPGLTNQPGTDLHPGEFDTMQSPSTPIKDLDERTCRSSGSKSRGRGRKNNPSPPPDSDLERVFVWDLDETIIVFHSLLTGSYAQKYGKDPPMAVTLGLRMEEMIFNLADTHLFFNDLEECDQVHIDDVSSDDNGQDLSTYSFATDGFHAAASSANLCLPTGVRGGVDWMRKLAFRYRRVKELYNTYKNNVGGLLGPAKRDAWLQLRAEIEGLTDSWLTNALKSLSIISTRSNCINVLVTTTQLIPALAKVLLYSLGGAFPIENIYSATKIGKESCFERIMQRFGRKVVYVVIGDGVEEEQAAKKHNMPFWRISSHSDLLALHQALELEYL

SEQ ID NO: 848426 - protein, 128 aa, Homo sapiens
TPLCGARKDPATKDPTVNGRGCGWVAAAGLAGPRAGHREAATPAPSANQDPPPRAAAQSPLGLKPSSAAPAPPARTRCGTRGAGGGVLARRCVRETVGANIRAFRRRGRAPFQPQSDGSGVVGPGPSV

SEQ ID NO: 848427 - protein, 198 aa, Homo sapiens
NRRANTTPSSSPRADRLAFPLVTIPPFHDPLKKAQYDKDNEKRTLLQCETGKIYSIKEFKEVEKVQLHSRFPQISNSRHFITPNEWLKLPTRYIESEFCRRRRLKVKVNFNDCSFDLKPLARAPYLLESQEEEKTVIYKNKGSSFLEREPLCYQEGNNPSAKEAISEGYFSSLSLSQEREEDQDGSPSPRLGLLKLEL

SEQ ID NO: 848428 - protein, 187 aa, Homo sapiens
MSKKDPNFLKVTIPPFHDPLKKAQYDKDNEKRTLLQCETGKIYSIKEFKEVEKVQLHSRFPQISNSRHFITPNEWLKLPTRYIESEFCRRRRLKVKVNFNDCSFDLKPLARAPYLLESQEEEKTVIYKNKGSSFLEREPLCYQEGNNPSAKEAISEGYFSSLSLSQEREEDQDGSPSPRLGLLKLEL

SEQ ID NO: 848429 - protein, 477 aa, Homo sapiens
TPLCGARKDPATKDPTVNGRGCGWVAAAGLAGPRAGHREAATPAPSANQDPPPRAAAQSPLGLKPSSAAPAPPARTRCGTRGAGGGVLARRCVRETVGANIRAFPDAGGLPSSRSRTAPGSSGRARVCSRTAAGLLALGGQRVFPGALLFVTTMKNVDSDDLVTGTLPKLKSSKEWLEPKPLCFMEVLAKEDTEAAIQSILYKENSVIKELDKYLQHHAFLNARRKEMLYKRWVDCVADPLQKKIIEKVCSHKKIKKRRQGELDGFLKHVNKKGNAFIEHYDPKEYDPFYMSKKDPNFLKVTIPPFHDPLKKAQYDKDNEKRTLLQCETGKIYSIKEFKEVEKVQLHSRFPQISNSRHFITPNEWLKLPTRYIESEFCRRRRLKVKVNFNDCSFDLKPLARAPYLLESQEEEKTVIYKNKGSSFLEREPLCYQEGNNPSAKEAISEGYFSSLSLSQEREEDQDGSPSPRLGLLKLEL

SEQ ID NO: 848430 - protein, 428 aa, Homo sapiens
TPLCGARKDPATKDPTVNGRGCGWVAAAGLAGPRAGHREAATPAPSANQDPPPRAAAQSPLGLKPSSAAPAPPARTRCGTRGAGGGVLARAACRSPGKNGWGPAPQTQFSPGGFPPAETGRGPGLPSSRSRTAPGSSGRARVCSRTAAGLLALGGQRVFPGALLFVTTMKNVDSDDLVTGTLPKLKSSKEWLEPKPLCFMEVLAKEDTEAAIQSILYKENSVIKGNAFIEHYDPKEYDPFYMSKKDPNFLKVTIPPFHDPLKKAQYDKDNEKRTLLQCETGKIYSIKEFKEVEKVQLHSRFPQISNSRHFITPNEWLKLPTRYIESEFCRRRRLKVKVNFNDCSFDLKPLARAPYLLESQEEEKTVIYKNKGSSFLEREPLCYQEGNNPSAKEAISEGYFSSLSLSQEREEDQDGSPSPRLGLLKLEL

SEQ ID NO: 848431 - protein, 187 aa, Homo sapiens; identical to SEQ ID NO: 848428

SEQ ID NO: 848432 - protein, 350 aa, Homo sapiens
TPLCGARKDPATKDPTVNGRGCGWVAAAGLAGPRAGHREAATPAPSANQDPPPRAAAQSPLGLKPSSAAPAPPARTRCGTRGAGGGVLARRCVRETVLAKEDTEAAIQSILYKENSVIKELDKYLQHHAFLNARRKEMLYKRWVDCVADPLQKKIIEKVCSHKKIKKRRQGELDGFLKHVNKKGNAFIEHYDPKEYDPFYMSKKDPNFLKVTIPPFHDPLKKAQYDKDNEKRTLLQCETGKIYSIKEFKEVEKVQLHSRFPQISNSRHFITPNEWLKLPTRYIESEFCRRRRNKGSSFLEREPLCYQEGNNPSAKEAISEGYFSSLSLSQEREEDQDGSSLCRCDHPSNS

SEQ ID NO: 848433 - protein, 130 aa, Homo sapiens
GVSELIECEQVGHNGERPPGKIYSIKEFKEVEKVQLHSRFPQISNSRHFITPNEWLKLPTRYIESEFCRRRRNKGSSFLEREPLCYQEGNNPSAKEAISEGYFSSLSLSQEREEDQDGSSLCRCDHPSNS

SEQ ID NO: 848434 - protein, 387 aa, Homo sapiens
TPLCGARKDPATKDPTVNGRGCGWVAAAGLAGPRAGHREAATPAPSANQDPPPRAAAQSPLGLKPSSAAPAPPARTRCGTRGAGGGVLARRCVRETVLAKEDTEAAIQSILYKENSVIKELDKYLQHHAFLNARRKEMLYKRWVDCVADPLQKKIIEKVCSHKKIKKRRQGELDGFLKHVNKKGNAFIEHYDPKEYDPFYMSKKDPNFLKVTIPPFHDPLKKAQYDKDNEKRTLLQCETGKIYSIKEFKEVEKVQLHSRFPQISNSRHFITPNEWLKLPTRYIESEFCRRRRLKVKVNFNDCSFDLKPLARAPYLLESQEEEKTVIYKNKGSSFLEREPLCYQEGNNPSAKEAISEGYFSSLSLSQEREEDQDGSPSPRLGLLKLEL

SEQ ID NO: 848435 - protein, 385 aa, Homo sapiens
TPLCGARKDPATKDPTVNGRGCGWVAAAGLAGPRAGHREAATPAPSANQDPPPRAAAQSPLGLKPSSAAPAPPARTRCGTRGAGGGVLARRCVRETVLAKEDTEAAIQSILYKENSVIKELDKYLQHHAFLNARRKEMLYKRWVDCVADPLQKKIIEKVCSHKKIKKRRQGELDGFLKHVNKKGNAFIEHYDPKEYDPFYMSKKDPNFLKVTIPPFHDPLKKAQYDKDNEKRTLLQCETGKIYSIKEFKEVEKVQLHSRFPQISNSRHFITPNEWLKLPTRYIESEFCRRRRLKVKVNFNDCSFDLKPLARAPYLLESQEEEKTVIYKNKGSSFLEREPLCYQEGNNPSAKEAISEGYFSSLSLSQEREEDQDGFQQPRSTHPDP

SEQ ID NO: 848436 - protein, 68 aa, Homo sapiens
PRPHRQGAAFRFRAGGRGTARVRRPPKAAGPKPELLPLRRPRGWGSRFRSGPRARGRRQVKRLLSSPS

SEQ ID NO: 848437 - protein, 86 aa, Homo sapiens
PRPHRQGAAFRFRAGGRGTARVRRPPKAAGPKPELLPLRRPRGWGSRFRSGPRARGRRQGEAVDAEARENLLLLLQRKWLGQAVEE

SEQ ID NO: 848438 - protein, 465 aa, Homo sapiens
MAHVRHFRTLVSGFYFWEAALLLSLVATKETDSARSRSAPMSPSDFLDKLMGRTSGYDARIRPNFKGPPVNVTCNIFINSFGSIAETTMDYRVNIFLRQKWNDPRLAYSEYPDDSLDLDPSMLDSIWKPDLFFANEKGANFHEVTTDNKLLRIFKNGNVLYSIRLTLTLSCPMDLKNFPMDVQTCIMQLESFGYTMNDLIFEWQDEAPVQVAEGLTLPQFLLKEEKDLRYCTKHYNTGKFTCIEVRFHLERQMGYYLIQMYIPSLLIVILSWVSFWINMDAAPARVALGITTVLTMTTQSSGSRASLPKVSYVKAIDIWMAVCLLFVFSALLEYAAVNFVSRQHKELLRFRRKRKNKTEAFALEKFYRFSDMDDEVRESRFSFTAYGMGPCLQAKDGMTPKGPNHPVQVMPKSPDEMRKVFIDRAKKIDTISRACFPLAFLIFNIFYWVIYKILRHEDIHHQQQD

SEQ ID NO: 848439 - protein, 193 aa, Homo sapiens
MAHVRHFRTLVSGFYFWEAALLLSLVATKETDSARSRSAPMSPSDFLDKLMGRTSGYDARIRPNFKGPPVNVTCNIFINSFGSIAETTMDYRVNIFLRQKWNDPRLAYSEYPDDSLDLDPSMLDSIWKPDLFFANEKGANFHEVTTDNKLLRIFKNGNVLYSISMNSNETDGLSAPRFCLLYPGLHNPKLNFF

SEQ ID NO: 848440 - protein, 240 aa, Homo sapiens
MAHVRHFRTLVSGFYFWEAALLLSLVATKETDSARSRSAPMSPSDFLDKLMGRTSGYDARIRPNFKGPPVNVTCNIFINSFGSIAETTMDYRVNIFLRQKWNDPRLAYSEYPDDSLDLDPSMLDSIWKPDLFFANEKGANFHEVTTDNKLLRIFKNGNVLYSIRLTLTLSCPMDLKNFPMDVQTCIMQLESFGYTMNDLIFEWQDEAPVQVAEGLTLPQFLLKEEKDLRYCTKHYNTGRG

SEQ ID NO: 848441 - protein, 450 aa, Homo sapiens
MAHVRHFRTLVSGFYFWEAALLLSLVATKETDSARSRSAPMSPSDFLDKLMGRTSGYDARIRPNFKGPPVNVTCNIFINSFGSIAETTMDYRVNIFLRQKWNDPRLAYSEYPDDSLDLDPSMLDSIWKPDLFFANEKGANFHEVTTDNKLLRIFKNGNVLYSIRLTLTLSCPMDLKNFPMDVQTCIMQLESFGYTMNDLIFEWQDEAPVQVAEGLTLPQFLLKEEKDLRYCTKHYNTGKFTCIEVRFHLERQMGYYLIQMYIPSLLIVILSWVSFWINMDAAPARVALGITTVLTMTTQSSGSRASLPKVSYVKAIDIWMAVCLLFVFSALLEYAAVNFVSRQHKELLRFRRKRKNKDDEVRESRFSFTAYGMGPCLQAKDGMTPKGPNHPVQVMPKSPDEMRKVFIDRAKKIDTISRACFPLAFLIFNIFYWVIYKILRHEDIHHQQQD

SEQ ID NO: 848442 - protein, 127 aa, Homo sapiens
KGQISKLYQHSLKDYRVNIFLRQKWNDPRLAYSEYPDDSLDLDPSMLDSIWKPDLFFANEKGANFHEVTTDNKLLRIFKNGNVLYSIRLTLTLSCPMDLKNFPMDVQTCIMQLESCLGNLGLKPKRE

SEQ ID NO: 848443 - protein, 192 aa, Homo sapiens
YVGTDSLNYHRYTDYRVNIFLRQKWNDPRLAYSEYPDDSLDLDPSMLDSIWKPDLFFANEKGANFHEVTTDNKLLRIFLNGRCSLFNKDYRVNIFLRQKWNDPRLAYSEYPDDSLDLDPSMLDSIWKPDLFFANEKGANFHEVTTDNKLLRIFKNGNVLYSISMNSNETDGLSAPRFCLLYPGLHNPKLNFF

SEQ ID NO: 848444 - protein, 670 aa, Homo sapiens
MNQVTDWVDPSFDDFLECSGVSTITATSLGVNNSSHRRKNGPSTLESSRFPARKRGNLSSLEQIYGLENSKEYLSENEPWVDKYKPETQHELAVHKKKIEEVETWLKAQVLERQPKQGGSILLITGPPGCGKTTTLKILSKEHGIQVQEWINPVLPDFQKDDFKGMFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCLQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 848445 - protein, 670 aa, Homo sapiens; identical to SEQ ID NO: 848444

SEQ ID NO: 848446 - protein, 670 aa, Homo sapiens; identical to SEQ ID NO: 848444

SEQ ID NO: 848447 - protein, 681 aa, Homo sapiens
MSKTFLRPKVSSTKVTDWVDPSFDDFLECSGVSTITATSLGVNNSSHRRKNGPSTLESSRFPARKRGNLSSLEQIYGLENSKEYLSENEPWVDKYKPETQHELAVHKKKIEEVETWLKAQVLERQPKQGGSILLITGPPGCGKTTTLKILSKEHGIQVQEWINPVLPDFQKDDFKGMFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCLQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 848448 - protein, 670 aa, Homo sapiens; identical to SEQ ID NO: 848444

SEQ ID NO: 848449 - protein, 542 aa, Homo sapiens
ENCLNLGGGGCSEPRLRHCTPAWATEQDSVSKQTNQTLITEESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCLQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 848450 - protein, 102 aa, Homo sapiens
MTKDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 848451 - protein, 670 aa, Homo sapiens; identical to SEQ ID NO: 848444

SEQ ID NO: 848452 - protein, 670 aa, Homo sapiens; identical to SEQ ID NO: 848444

SEQ ID NO: 848453 - protein, 670 aa, Homo sapiens; identical to SEQ ID NO: 848444

SEQ ID NO: 848454 - protein, 505 aa, Homo sapiens
MFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCLQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 848455 - protein, 584 aa, Homo sapiens
MNQHELAVHKKKIEEVETWLKAQVLERQPKQGGSILLITGPPGCGKTTTLKILSKEHGIQVQEWINPVLPDFQKDDFKGMFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCLQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 848456 - protein, 505 aa, Homo sapiens; identical to SEQ ID NO: 848454

SEQ ID NO: 848457 - protein, 105 aa, Homo sapiens
NTLQVLQKQKLQHRKTFKVNRLARHLPLSNGGIKTLPVWGRDKVVVTEILLVVLLDAGAAGVGWLFTGEYISSHLLLFSLQGNYFITNWWQLAAVATAAAGICFL

SEQ ID NO: 848458 - protein, 83 aa, Homo sapiens
MSPAGGPQFCARSPVFLRSPGVVAPSSGSARCNKSKRTQGAGTLFTPPFVARGTTVPAPGGPLGRKEPLSFRGGGPHYVRPPL

SEQ ID NO: 848459 - protein, 243 aa, Homo sapiens
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDKRPFPKELQNSVLETTLMPHNYSRCYTCQVSNSVSSKNGTVCLSPPCTLARSFGVEWIASWLVVTVPTILGLLLT

SEQ ID NO: 848460 - protein, 137 aa, Homo sapiens [sequence omitted]

SEQ ID NO: 848461 - protein, 163 aa, Homo sapiens
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLELLSETVMCDTWRVCKLHLVWGQKALPKGAPEQCA

SEQ ID NO: 848462 - protein, 169 aa, Homo sapiens
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLGESGEPKSKSPLQWPQMDHCRASWEAWGTLGEEERKTSGQV

SEQ ID NO: 848463 - protein, 243 aa, Homo sapiens; identical to SEQ ID NO: 848459

SEQ ID NO: 848464 - protein, 211 aa, Homo sapiens
MTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDKRPFPKELQNSVLETTLMPHNYSRCYTCQVSNSVSSKNGTVCLSPPCTLARSFGVEWIASWLVVTVPTILGLLLT

SEQ ID NO: 848465 - protein, 225 aa, Homo sapiens
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDPHNYSRCYTCQVSNSVSSKNGTVCLSPPCTLARSFGVEWIASWLVVTVPTILGLLLT

SEQ ID NO: 848466 - protein, 160 aa, Homo sapiens
MKAQENEGHGVGGGTSAQVLPAASLIQMPLPSLRRLRSVHCEPRTVTSTMSCQQVTALAVAPGSCAVSGLFDPCVPLKRHDLHGQCLFSWPLSEPNAVLVRAVLVGRGWAQRNQVARAAGGGTWSRTRGAGTTSNPGDILDSVKDKQSRTLIKAVKTFYS

SEQ ID NO: 848467 - protein, 342 aa, Homo sapiens
PPISAGSRKPPRTSSPGRGRGSCAWRKPRNPQRPSMAWSLGSWLGGCLLVSALGMVPPPAAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPSWMVAVILMASVFMVCLALLGCFALLWCVYKKTKYAFSPRNSLPQHLKEFLGHPHHNTLLFFSFPLSDENDVFDKLSVIAEDSESGKQNPGDSCSLGTPPGQGPQS

SEQ ID NO: 848468 - protein, 257 aa, Homo sapiens
PPISAGSRKPPRTSSPGRGRGSCAWRKPRNPQRPSMAWSLGSWLGGCLLVSALGMVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDVFGPSSS

SEQ ID NO: 848469 - protein, 360 aa, Homo sapiens
PPISAGSRKPPRTSSPGRGRGSCAWRKPRNPQRPSMAWSLGSWLGGCLLVSALGMVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPSWMVAVILMASVFMVCLALLGCFALLWCVYKKTKYAFSPRNSLPQHLKEFLGHPHHNTLLFFSFPLSDENDVFDKLSVIAEDSESGKQNPGDSCSLGTPPGQGPQS

SEQ ID NO: 848470 - protein, 118 aa, Homo sapiens
RGQALPGAGGGRVLGGSRGTPSVRPWRGALGAGWVAACWCQVRGPRGGGALGNREAPRDAAPDPIPGRPASDLRAFGASGEKMQTPRPAAETQLGCCCRRFCNRRKPHPRPDYRPSGP

SEQ ID NO: 848471 - protein, 360 aa, Homo sapiens; identical to SEQ ID NO: 848469

SEQ ID NO: 848472 - protein, 291 aa, Homo sapiens
VVIMLTLQLPEDSSVLRIDNQDVLNISEHTIAKTPTGIRYPTMLSPKTSTVKSTKRLPLGWQPCPMSRPSFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPSWMVAVILMASVFMVCLALLGCFALLWCVYKKTKYAFSPRNSLPQHLKEFLGHPHHNTLLFFSFPLSDENDVFDKLSVIAEDSESGKQNPGDSCSLGTPPGQGPQS

SEQ ID NO: 848473 - protein, 253 aa, Homo sapiens
PPISAGSRKPPRTSSPGRGRGSCAWRKPRNPQRPSMAWSLGSWLGGCLLVSALGMVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDGKP

SEQ ID NO: 848474 - protein, 177 aa, Homo sapiens
LGSCGSDLWFLRLLTLQTQPRGSPAAAHPGKPFLTRSSHPNIILSLLLQLLRAQVRHGLAPAWITAAAPLAGSADPSGFAASCDVSAKISSLVCKQLHSQGGSSGLSAGAAYSDVRPGFTSFPDLDMSPSPLGPLTLRCPLRSPSSPLAPGSPTLSHTHTITDAHACTRAGLEICFT

SEQ ID NO: 848475 - protein, 73 aa, Homo sapiens
TGSLTWTSPSLAPEIHHFCRLFCDATTRSHLGSADPSGFAASCDVSAKISSLVCKQLHSQGGSSGLSAGAGEE

SEQ ID NO: 848476 - protein, 120 aa, Homo sapiens
LALPWWWTCSASLMFALSDPNDVRCSSTLVTHSKGYENGTNRLRLQKQILKSEKNKPLKGTKAPAPQVMGPEQAAQGYWAGSQIPSNGEEAAIHKARHSALTTCPQNTLRVHTPARLRDE

SEQ ID NO: 848477 - protein, 533 aa, Homo sapiens
MARLPAGIRFIISFSRDQWYRAFIFILTFLLYASFHLSRKPISIVKGELHKYCTAWDEADVRFSSQNRKSGSAAPHQLPDNETDCGWAPFDKNNYQQLLGALDYSFLCAYAVGMYLSGIIGERLPIRYYLTFGMLASGAFTALFGLGYFYNIHSFGFYVVTQVINGLVQTTGWPSVVTCLGNWFGKGRRGLIMGVWNSHTSVGNILGSLIAGYWVSTCWGLSFVVPGAIVAAMGIVCFLFLIEHPNDVRCSSTLVTHSKGYENGTNRLRLQKQILKSEKNKPLDPEMQCLLLSDGKGSIHPNHVVILPGDGGSGTAAISFTGALKIPGVIEFSLCLLFAKLVSYTFLFWLPLYITNVDHLDAKKAGELSTLFDVGGIFGGILAGVISDRLEKRASTCGLMLLLAAPTLYIFSTISKMGLEATIAMLLLSGALVSGPYTLITTAVSADLGTHKSLKGNAHALSTVTAIIDGTGSVGAALGPLLAGLLSPSGWSNVFYMLMFADACALLFLIRLIHKELSCPGSATGDQVPFKEQ

SEQ ID NO: 848478 - protein, 533 aa, Homo sapiens; identical to SEQ ID NO: 848477

SEQ ID NO: 848479 - protein, 117 aa, Homo sapiens
MFRTDLKTNCREAKGEEAGSTSGWRHPGLPATERPEVTVIPAPGLPAALRGHGAAVQLRHRGTAEVWEAVSPPALGLAGPSPATGFAPQHTPHLGLFLIHSNRLGYLFKMCIVSYEV

SEQ ID NO: 848480 - protein, 383 aa, Homo sapiens
MARLPAGIRFIISFSRDQWYRAFIFILTFLLYASFHLSRKPISIVKGELHKYCTAWDEADVRFSSQNRKSGSAAPHQLPDNETDCGWAPFDKNNYQQLLGALDYSFLCAYAVGMYLSGIIGERLPIRYYLTFGMLASGAFTALFGLGYFYNIHSFGFYVVTQVINGLVQTTGWPSVVTCLGNWFGKGRRGLIMGVWNSHTSVGNILGSLIAGYWVSTCWGLSFVVPGAIVAAMGIVCFLFLIEHPNDVRCSSTLVTHSKGYENGTNRLRLQKQILKSEKNKPLDPEMQCLLLSDGKGSIHPNHVVILPGDGGSGTAAISFTGALKIPGVIEFSLCLLFAKLVSYTFLFWLPLYITNVDHLDAKKAGCTGSPDPLRHSSHRTSK

SEQ ID NO: 848481 - protein, 533 aa, Homo sapiens; identical to SEQ ID NO: 848477

SEQ ID NO: 848482 - protein, 533 aa, Homo sapiens; identical to SEQ ID NO: 848477

SEQ ID NO: 848483 - protein, 533 aa, Homo sapiens; identical to SEQ ID NO: 848477

SEQ ID NO: 848484 - protein, 395 aa, Homo sapiens
MARLPAGIRFIISFSRDQWYRAFIFILTFLLYASFHLSRKPISIVKGELHKYCTAWDEADVRFSSQNRKSGSAAPHQLPDNETDCGWAPFDKNNYQQLLGALDYSFLCAYAVGMYLSGIIGERLPIRYYLTFGMLASGAFTALFGLGYFYNIHSFGFYVVTQVINGLVQTTGWPSVVTCLGNWFGKGRRGLIMGVWNSHTSVGNILGSLIAGYWVSTCWGLSFVVPGAIVAAMGIVCFLFLIEHPNDVRCSSTLVTHSKGYENGTNRLRLQKQILKSEKNKPLDPEMQCLLLSDGKGSIHPNHVVILPGDGGSGTAAISFTGALKIPGVIEFSLCLLFAKLVSYTFLFWLPLYITNVDHLDAKKAGELSTLFDVGGIFGEFIKTCSAATIISQGA

SEQ ID NO: 848485 - protein, 69 aa, Homo sapiens
WGAVAQTSGFCASSLSKPNLEVPPPLRTLGSPFSPGALTPISFSPSSSNSSEPRSDMVSPQPGSQPQRL

SEQ ID NO: 848486 - protein, 144 aa, Homo sapiens
GKFAQVRLCREEGGPRGRPSREWRATVATVPLYFVSSLYRIERLLSLNTCCCIASENGRTYPHSHQNRVWDSLLPRLLHKLKRNLQQMGSGNKLAPEWSSATEECFTERNLFYGPLVLETTSSSLTSLATSPDAVGQTGLSHPR

SEQ ID NO: 848487 - protein, 117 aa, Homo sapiens
GKFAQVRLCREEGGPRGRPSREWRATVATVPLYFVSSLYRIERLLSLNTCCCIASENGRTYPHSHQNRVWDSLLPRLLCNLPRDAVSNCCRPLLTISLVVLLTHSLHNWNVFPGQPP

SEQ ID NO: 848488 - protein, 533 aa, Homo sapiens; identical to SEQ ID NO: 848477

SEQ ID NO: 848489 - protein, 533 aa, Homo sapiens; identical to SEQ ID NO: 848477

SEQ ID NO: 848490 - protein, 227 aa, Homo sapiens
DLRIPWYGSGRRHHHRALKIPGVIEFSLCLLFAKLVSYTFLFWLPLYITNVDHLDAKKAGELSTLFDVGGIFGGILAGVISDRLEKRASTCGLMLLLAAPTLYIFSTISKMGLEATIAMLLLSGALVSGPYTLITTAVSADLGTHKSLKGNAHALSTVTAIIDGTGSVGAALGPLLAGLLSPSGWSNVFYMLMFADACALLFLIRLIHKELSCPGSATGDQVPFKEQ

SEQ ID NO: 848491 - protein, 533 aa, Homo sapiens; identical to SEQ ID NO: 848477

SEQ ID NO: 848492 - protein, 533 aa, Homo sapiens; identical to SEQ ID NO: 848477

SEQ ID NO: 848493 - protein, 546 aa, Homo sapiens
MARLPAGIRFIISFSRDQWYRAFIFILTFLLYASFHLSRKPISIVKGELHKYCTAWDEADVRFSSQNRKSGSAAPHQLPDNETDCGWAPFDKNNYQQLLGALDYSFLCAYAVGMYLSGIIGERLPIRYYLTFGMLASGAFTALFGLGYFYNIHSFGFYVVTQVINGLVQTTGWPSVVTCLGNWFGKGRRGLIMGVWNSHTSVGNILGSLIAGYWVSTCWGLSFVVPGAIVAAMGIVCFLFLIEHPNDVRCSSTLVTHSKGYENGTNRLRLQKQILKSEKNKPLDPEMQCLLLSDGKGSIHPNHVVILPGDGGSGTAAISFTGALKIPGVIEFSLCLLFAKLVSYTFLFWLPLYITNVDHLDAKKAGELSTLFDVGGIFGGILAGVISDRLEKRASTCGLMLLLAAPTLYIFSTISKMGLEATIAMLLLSGALVSGPYTLITTAVSADLGTHKSLKGNAHALSTVTAIIDGTGSVGAALGPLLAGLLSPSGWSNVFYMLMFADACALLEILKLNFPTTYKIKYQLSTYELTRFKWLFFGSSVGSFNA

SEQ ID NO: 848494 - protein, 290 aa, Homo sapiens
MARLPAGIRFIISFSRDQWYRAFIFILTFLLYASFHLSRKPISIVKGELHKYCTAWDEADVRFSSQNRKSGSAAPHQLPDNETDCGWAPFDKNNYQQLLGALDYSFLCAYAVGMYLSGIIGERLPIRYYLTFGMLASGAFTALFGLGYFYNIHSFGFYVVTQVINGLVQTTGWPSVVTCLGNWFGKGRRGLIMGVWNSHTSVGNILGSLIAGYWVSTCWGLSFVVPGAIVAAMGIVCFLFLIEHPNDVRCSSTLVTVRTLFSCPFLEQCAVLTTSPACSCLCGVRQKHTG

SEQ ID NO: 848495 - protein, 96 aa, Homo sapiens
LGSLAPLHPDCPAGNTFPFCSQWICLQDPEMQCLLLSDGKGSIHPNHVVILPGDGGSGTAAISFTGALKIPVSKRAQEEFQKGLLCWLWEVWSVDD

SEQ ID NO: 848496 - protein, 776 aa, Homo sapiens
MAAPGDPQDELLPLAGPGSQWLRHRGEGENEAVTPKGATPAPQAGEPSPGLGARAREAASREAGSGPARQSPVAMETASTGVAGVSSAMDHTFSTTSKDGEGSCYTSLISDICYPPQEDSTYFTGILQKENGHVTISESPEELGTPGPSLPDVPGIESRGLFSSDSGIEMTPAESTEVNKILADPLDQMKAEAYKYIDITRPEEVKHQEQHHPELEDKDLDFKNKDTDISIKPEGVREPDKPAPVEGKIIKDHLLEESTFAPYIDDLSEEQRRAPQITTPVKITLTEIEPSVETTTQEKTPEKQDICLKPSPDTVPTVTVSEPEDDSPGSITPPSSGTEPSAAESQGKGSISEDELITAIKEAKGLSYETAENPRPVGQLADRPEVKARSGPPTIPSPLDHEASSAESGDSEIELVSEDPMAAEDALPSGYVSFGHVGGPPPSPASPSIQYSILREEREAELDSELIIESCDASSASEESPKREQDSPPMKPSALDAIREETGVRAEERAPSRRGLAEPGSFLDYPSTEPQPGPELPPGDGALEPETPMLPRKPEEDSSSNQSPAATKGPGPLGPGAPPPLLFLNKQKAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 848497 - protein, 452 aa, Homo sapiens
CVCLRGSPSLCGTTEPSAAESQGKGSISEDELITAIKEAKGLSYETAENPRPVGQLADRPEVKARSGPPTIPSPLDHEASSAESGDSEIELVSEDPMAAEDALPSGYVSFGHVGGPPPSPASPSIQYSILREEREAELDSELIIESCDASSASEESPKREQDSPPMKPSALDAIREETGVRAEERAPSRRGLAEPGSFLDYPSTEPQPGPELPPGDGALEPETPMLPRKPEEDSSSNQSPAATKGPGPLGPGAPPPLLFLNKQKAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 848498 - protein, 208 aa, Homo sapiens
MQATADSTKMDCVWSNWKSQAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 848499 - protein, 208 aa, Homo sapiens; identical to SEQ ID NO: 848498

SEQ ID NO: 848500 - protein, 208 aa, Homo sapiens; identical to SEQ ID NO: 848498

SEQ ID NO: 848501 - protein, 214 aa, Homo sapiens
MQATADSTKMDCVWSNWKSQAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKNQADTDRNVLSGTGLFYSY

SEQ ID NO: 848502 - protein, 233 aa, Homo sapiens
MAAPGDPQDELLPLAGPGSQWLRHRGEGENEAVTPKGATPAPQAGEPSPGLGARAREAASREAGSGPARQSPVAMETASTGVAGVSSAMDHTFSTTSKDGEGSCYTSLISDICYPPQEDSTYFTGILQKENGHVTISESPEELGTPGPSLPDVPGIESRGLFSSDSGIEMTPAESTEVNKILADPLDQMKAEAYKYIDITRPEEVKHQEQHHPELEDKEQTLKQLFLGCSLYS

SEQ ID NO: 848503 - protein, 163 aa, Homo sapiens
MQATADSTKMDCVWSNWKSQAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMGKSR

SEQ ID NO: 848504 - protein, 782 aa, Homo sapiens
MAAPGDPQDELLPLAGPGSQWLRHRGEGENEAVTPKGATPAPQAGEPSPGLGARAREAASREAGSGPARQSPVAMETASTGVAGVSSAMDHTFSTTSKDGEGSCYTSLISDICYPPQEDSTYFTGILQKENGHVTISESPEELGTPGPSLPDVPGIESRGLFSSDSGIEMTPAESTEVNKILADPLDQMKAEAYKYIDITRPEEVKHQEQHHPELEDKDLDFKNKDTDISIKPEGVREPDKPAPVEGKIIKDHLLEESTFAPYIDDLSEEQRRAPQITTPVKITLTEIEPSVETTTQEKTPEKQDICLKPSPDTVPTVTVSEPEDDSPGSITPPSSGTEPSAAESQGKGSISEDELITAIKEAKGLSYETAENPRPVGQLADRPEVKARSGPPTIPSPLDHEASSAESGDSEIELVSEDPMAAEDALPSGYVSFGHVGGPPPSPASPSIQYSILREEREAELDSELIIESCDASSASEESPKREQDSPPMKPSALDAIREETGVRAEERAPSRRGLAEPGSFLDYPSTEPQPGPELPPGDGALEPETPMLPRKPEEDSSSNQSPAATKGPGPLGPGAPPPLLFLNKQKAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKNQADTDRNVLSGTGLFYSY

SEQ ID NO: 848505 - protein, 600 aa, Homo sapiens
MAAPGDPQDELLPLAGPGSQWLRHRGEGENEAVTPKGATPAPQAGEPSPGLGARAREAASREAGSGPARQSPVAMETASTGVAGVSSAMDHTFSTTSKDGEGSCYTSLISDICYPPQEDSTYFTGILQKENGHVTISESPEELGTPGPSLPDVPGIESRGLFSSDSGIEMTPAESTEVNKILADPLDQMKAEAYKYIDITRPEEVKHQEQHHPELEDKDLDFKNKDTDISIKPEGVREPDKPAPVEGKIIKDHLLEESTFAPYIDDLSEEQRRAPQITTPVKITLTEIEPSVETTTQEKTPEKQDICLKPSPDTVPTVTVSEPEDDSPGSITPPSSGTEPSAAESQGKGSISEDELITAIKEAKGLSYETAENPRPVGQLADRPEVKARSGPPTIPSPLDHEASSAESGDSEIELVSEDPMAAEDALPSGYVSFGHVGGPPPSPASPSIQYSILREEREAELDSELIIESCDASSASEESPKREQDSPPMKPSALDAIREETGVRAEERAPSRRGLAEPGSFLDYPSTEPQPGPELPPGDGALEPETPMLPRKPEEDSSSNQSPAATKGPGPLGPGAPPPLLFLNKQKAVGYQHPWKKMS

SEQ ID NO: 848506 - protein, 208 aa, Homo sapiens; identical to SEQ ID NO: 848498

SEQ ID NO: 848507 - protein, 208 aa, Homo sapiens; identical to SEQ ID NO: 848498

SEQ ID NO: 848508 - protein, 208 aa, Homo sapiens; identical to SEQ ID NO: 848498

SEQ ID NO: 848509 - protein, 118 aa, Homo sapiens
MQATADSTKMDCVWSNWKSQAIDLLYWRDIKQTGIVFGSFLLLLFSLTQFSVVSVVAYLALAALSATISFRIYKSVLQAVQKTDEGHPFKAYLELEITLSQEQIQKYTDGHKQECLEW

SEQ ID NO: 848510 - protein, 731 aa, Homo sapiens
MAAPGDPQDELLPLAGPGSQWLRHRGEGENEAVTPKGATPAPQAGEPSPGLGARAREAASREAGSGPARQSPVAMETASTGVAGVSSAMDHTFSTTSKDGEGSCYTSLISDICYPPQEDSTYFTGILQKENGHVTISESPEELGTPGPSLPDVPGIESRGLFSSDSGIEMTPAESTEVNKILADPLDQMKAEAYKYIDITRPEEVKHQEQHHPELEDKDLDFKNKDTDISIKPEGVREPDKPAPVEGKIIKDHLLEESTFAPYIDDLSEEQRRAPQITTPVKITLTEIEPSVETTTQEKTPEKQDICLKPSPDTVPTVTVSEPEDDSPGSITPPSSGTEPSAAESQGKGSISEDELITAIKEAKGLSYETAENPRPVGQLADRPEVKARSGPPTIPSPLDHEASSAESGDSEIELVSEDPMAAEDALPSGYVSFGHVGGPPPSPASPSIQYSILREEREAELDSELIIESCDASSASEESPKREQDSPPMKPSALDAIREETGVRAEERAPSRRGLAEPGSFLDYPSTEPQPGPELPPGDGALEPETPMLPRKPEEDSSSNQSPAATKGPGPLGPGAPPPLLFLNKQKAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMGKSR

SEQ ID NO: 848511 - protein, 118 aa, Homo sapiens; identical to SEQ ID NO: 848509

SEQ ID NO: 848512 - protein, 190 aa, Homo sapiens
MQATADSTKMDCVWSNWKSQAIDLLYWRDIKQTGIVFGSFLLLLFSLTQFSVVSVVAYLALAALSATISFRIYKSVLQAVQSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 848513 - protein, 534 aa, Homo sapiens
SSARTRTRPGEAEGLCTCPREESREIRAGQIVLKAMAQGLVTFRDVAIEFSLEEWKCLEPAQRDLYREVTLENFGHLASLGLSISKPDVVSLLEQGKEPWMIANDVTGPWCPDLESRCEKFLQKDIFEIGAFNWEIMESLKCSDLEGSDFRADWECEGQFERQVNEECYFKQVNVTYGHMPVFQHHTSHTVRQSRETGEKLMECHECGKAFSRGSHLIQHQKTHTGEKPFGCKECGKAFSRASHLVQHQRIHTGEKPYDCKDCGKAFGRTSELILHQRLHTGVKPYECKECGKTFRQHSQLILHQRTHTGEKPYVCKDCGKAFIRGSQLTVHRRIHTGARPYECKECGKAFRQHSQLTVHQRIHTGEKPYECKECGKGFIHSSEVTRHQRIHSGEKPYECKECGKAFRQHAQLTRHQRVHTGDRPYECKDCGKAFSRSSYLIQHQRIHTGDKPYECKECGKAFIRVSQLTHHQRIHTCEKPYECRECGMAFIRSSQLTEHQRIHPGIKPYECRECGQAFILGSQLIEHYRIHTG

SEQ ID NO: 848514 - protein, 393 aa, Homo sapiens
MALKVATVAGSAAKAVLGPALLCRPWEVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENMHTPDIGGQGTTSEAIQDVIRHIRVINGRAVEA

SEQ ID NO: 848515 - protein, 340 aa, Homo sapiens
MALKVATVAGSAAKAVLGPALLCRPWEVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLK

SEQ ID NO: 848516 - protein, 132 aa, Homo sapiens
GSPGSTDVGPVRCAVPGRSRRHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILREIRVCG

SEQ ID NO: 848517 - protein, 380 aa, Homo sapiens
MALKVATVAGSAAKAVLGPALLCRPWEVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENVRFPSHPTLLPRPVSPCSLL

SEQ ID NO: 848518 - protein, 344 aa, Homo sapiens
MALKVATVAGSAAKAVLGPALLCRPWEVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQATRNTGKSIANKNIANPTATLLASCMMLDHLKLHSYATSIRKAVLASMDNENMHTPDIGGQGTTSEAIQDVIRHIRVINGRAVEA

SEQ ID NO: 848519 - protein, 261 aa, Homo sapiens
MALKVATVAGSAAKAVLGPALLCRPWEVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIAALLCHLHP

SEQ ID NO: 848520 - protein, 261 aa, Homo sapiens; identical to SEQ ID NO: 848519

SEQ ID NO: 848521 - protein, 524 aa, Homo sapiens
MTAPPISHEYYDPAEFMEGGPQEADRLDELEYEEVELYKSSHRDKLGLMVCYRTDDEEDLGIYVGEVNPNSIAAKDGRIREGDRIIQINGVDVQNREEAVAILSQEENTNISLLVARPESQLAKRWKDSDRDDFLDDFGSENEGELRARKLKSPPAQQVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENMHTPDIGGQGTTSEAIQDVIRHIRVINGRAVEA

SEQ ID NO: 848522 - protein, 261 aa, Homo sapiens; identical to SEQ ID NO: 848519

SEQ ID NO: 848523 - protein, 510 aa, Homo sapiens
MFFTQEISDFNKRPILLDNNVDGEVSIHRPHLVTEAQCNTLDHVLYMTTNSPNGSQFLSVTPPFVNPEPLFFLSKKAEFYIDVIEVPPQGSSGALHDNCASLQSNVDIFWNVDSLIAENVFILARAVSACRDVRRLSLSVMALKVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENMHTPDIGGQGTTSEAIQDVIRHIRVINGRAVEA

SEQ ID NO: 848524 - protein, 335 aa, Homo sapiens
MIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENMHTPDIGGQGTTSEAIQDVIRHIRVINGRAVEA

SEQ ID NO: 848525 - protein, 866 aa, Homo sapiens
ARVWPLAPARDPRSRARVSERRLPVPALRLLSPASNMGCNMCVVQKPEEQYKVMLQVNGKELSKLSQEQTLQALRSSKEPLVIQVLRRSPRLRGDSSCHDLQLVDSGTQTDITFEHIMALGKLRPPTPPMVILEPYVLSELAEGGPSCPGRRCRKCQGGGPQLLLLHPLSSAASQASLLESSCIPCLSHSSTCSEFPPSLQLLSLARPEEGPFIQAWWLMTAPPISHEYYDPAEFMEGGPQEADRLDELEYEEVELYKSSHRDKLGLMVCYRTDDEEDLGIYVGEVNPNSIAAKDGRIREGDRIIQINGVDVQNREEAVAILSQEENTNISLLVARPESQLAKRWKDSDRDDFLDDFGSENEGELRARKLKSPPAQQVLGAHEVPSRNIFSEQTIPPSAKYGGRHTVTMIPGDGIGPELMLHVKSVFRYGAPGSPPCPQPGGPEDFVPRGALRPEALGEAMARRPVSPGLRPMACDPARLAWARGRWHQSCHSVHCGVQACPHQSVKVGPVPSQSEPGQGRKQQERGSLGRLPGGGAGGSGPASLTLPCLRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENMHTPDIGGQGTTSEAIQDVIRHIRVINGRAVEA

SEQ ID NO: 848526 - protein, 516 aa, Homo sapiens
MALKVATVAGSAAKAVLGPALLCRPWEVLGAHEVPSRNIFSEQTIPPSAKYGGRHTVTMIPGDGIGPELMLHVKSVFRYGAPGSPPCPQPGGPEDFVPRGALRPEALGEAMARRPVSPGLRPMACDPARLAWARGRWHQSCHSVHCGVQACPHQSVKVGPVPSQSEPGQGRKQQERGSLGRLPGGGAGGSGPASLTLPCLRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENMHTPDIGGQGTTSEAIQDVIRHIRVINGRAVEA

SEQ ID NO: 848527 - protein, 250 aa, Homo sapiens
MALKVATVAGSAAKAVLGPALLCRPWEVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMLRGTPARVSPIRTSPTPRPPCWPAA

SEQ ID NO: 848528 - protein, 250 aa, Homo sapiens; identical to SEQ ID NO: 848527

SEQ ID NO: 848529 - protein, 278 aa, Homo sapiens
MALKVATVAGSAAKAVLGPALLCRPWEVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIINWDDGHLDSTAAGRSADRYPQRSLREPVTLMDNRHQHTMEVTRNYSSVIDIGE

SEQ ID NO: 848530 - protein, 85 aa, Homo sapiens
SGPFWAVVHTARCVLVDHHGLVASPGEPLHLKLHSYATSIRKAVLASMDNENMHTPDIGGQGTTSEAIQDVIRHIRVINGRAVEA

SEQ ID NO: 848531 - protein, 393 aa, Homo sapiens; identical to SEQ ID NO: 848514

SEQ ID NO: 848532 - protein, 583 aa, Homo sapiens
ARVWPLAPARDPRSRARVSERRLPVPALRLLSPASNMGCNMCVVQKPEEQYKVMLQVNGKELSKLSQEQTLQALRSSKEPLVIQVLRRSPRLRGDSSCHDLQLVDSGTQTDITFEHIMALGKLRPPTPPMVILEPPPISHEYYDPAEFMEGGPQEADRLDELEYEEVELYKSSHRDKLGLMVCYRTDDEEDLGIYVGEVNPNSIAAKDGRIREGDRIIQINGVDVQNREEAVAILSQEENTNISLLVARPESQLAKRWKDSDRDDFLDDFGSENEGELRARKLKSPPAQQPGNEEEKGAPDAGPGLSNSQELDSGVGRTDESTRNEESSEHDLLGDEPPSSTNTPGSLRKFGLQGDALQSRDFHFSMDSLLAEGAGLGGGDVPGLTDEEYERYRELLEIKCHLENGNQLGLLFPRASGGNSALDVNRNESLGHEMAMLEEELRHLEFKCRNILRAQKMQQLRERCMKAWLLEEESLYDLAASEPKKHELSDISELPEKSDKDSTSAYNTGESCRSTPLLVEPLPESPLRRAMAGNSNLNRTPPGPAVATPAKAAPPPGSPAKFRSLSRDPEAGRRQHAEERGR

SEQ ID NO: 848533 - protein, 405 aa, Homo sapiens
MALKVATVAGSAAKAVLGPALLCRPWEVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENGLVCAEPACVLQMHTPDIGGQGTTSEAIQDVIRHIRVINGRAVEA

SEQ ID NO: 848534 - protein, 743 aa, Homo sapiens
ARVWPLAPARDPRSRARVSERRLPVPALRLLSPASNMGCNMCVVQKPEEQYKVMLQVNGKELSKLSQEQTLQALRSSKEPLVIQVLRRSPRLRGDSSCHDLQLVDSGTQTDITFEHIMALGKLRPPTPPMVILEPYVLSELAEGGPSCPGRRCRKCQGGGPQLLLLHPLSSAASQASLLESSCIPCLSHSSTCSEFPPSLQLLSLARPEEGPFIQAWWLMTAPPISHEYYDPAEFMEGGPQEADRLDELEYEEVELYKSSHRDKLGLMVCYRTDDEEDLGIYVGEVNPNSIAAKDGRIREGDRIIQINGVDVQNREEAVAILSQEENTNISLLVARPESQLAKRWKDSDRDDFLDDFGSENEGELRARKLKSPPAQQVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENMHTPDIGGQGTTSEAIQDVIRHIRVINGRAVEA

SEQ ID NO: 848535 - protein, 656 aa, Homo sapiens
ARVWPLAPARDPRSRARVSERRLPVPALRLLSPASNMGCNMCVVQKPEEQYKVMLQVNGKELSKLSQEQTLQALRSSKEPLVIQVLRRSPRLRGDSSCHDLQLVDSGTQTDITFEHIMALGKLRPPTPPMVILEPPPISHEYYDPAEFMEGGPQEADRLDELEYEEVELYKSSHRDKLGLMVCYRTDDEEDLGIYVGEVNPNSIAAKDGRIREGDRIIQINGVDVQNREEAVAILSQEENTNISLLVARPESQLAKRWKDSDRDDFLDDFGSENEGELRARKLKSPPAQQVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENMHTPDIGGQGTTSEAIQDVIRHIRVINGRAVEA

SEQ ID NO: 848536 - protein, 508 aa, Homo sapiens
MEGGPQEADRLDELEYEEVELYKSSHRDKLGLMVCYRTDDEEDLGIYVGEVNPNSIAAKDGRIREGDRIIQINGVDVQNREEAVAILSQEENTNISLLVARPESQLAKRWKDSDRDDFLDDFGSENEGELRARKLKSPPAQQVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENMHTPDIGGQGTTSEAIQDVIRHIRVINGRAVEA

SEQ ID NO: 848537 - protein, 662 aa, Homo sapiens
ARVWPLAPARDPRSRARVSERRLPVPALRLLSPASNMGCNMCVVQKPEEQYKVMLQVNGKELSKLSQEQTLQALRSSKEPLVIQVLRRSPRLRGDSSCHDLQLVDSGTQTDITFEHIMALGKLRPPTPPMVILEPYVLSELPPISHEYYDPAEFMEGGPQEADRLDELEYEEVELYKSSHRDKLGLMVCYRTDDEEDLGIYVGEVNPNSIAAKDGRIREGDRIIQINGVDVQNREEAVAILSQEENTNISLLVARPESQLAKRWKDSDRDDFLDDFGSENEGELRARKLKSPPAQQVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENMHTPDIGGQGTTSEAIQDVIRHIRVINGRAVEA

SEQ ID NO: 848538 - protein, 335 aa, Homo sapiens; identical to SEQ ID NO: 848524

SEQ ID NO: 848539 - protein, 346 aa, Homo sapiens
QADRIEISTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENMHTPDIGGQGTTSEAIQDVIRHIRVINGRAVEA

SEQ ID NO: 848540 - protein, 895 aa, Homo sapiens
ARVWPLAPARDPRSRARVSERRLPVPALRLLSPASNMGCNMCVVQKPEEQYKVMLQVNGKELSKLSQEQTLQALRSSKEPLVIQVLRRSPRLRGDSSCHDLQLVDSGTQTDITFEHIMALGKLRPPTPPMVILEPYVLSELAEGGPSCPGRRCRKCQGGGPQLLLLHPLSSAASQASLLESSCIPCLSHSSTCSEFPPSLQLLSLARPEEGPFIQAWWLMTAPPISHEYYDPAEFMEGGPQEADRLDELEYEEVELYKSSHRDKLGLMVCYRTDDEEDLGIYVGEVNPNSIAAKDGRIREGDRIIQINGVDVQNREEAVAILSQEENTNISLLVARPESQLAKRWKDSDRDDFLDDFGSENEGELRARKLKSPPAQQVLGAHEVPSRNIFSEQTIPPSAKYGGRHTVTMIPGDGIGPELMLHVKSVFRYGAPGSPPCPQPGGPEDFVPRGALRPEALGEAMARRPVSPGLRPMACDPARLAWARGRWHQSCHSVHCGVQACPHQSVKVGPVPSQSEPGQGRKQQERGSLGRLPGGGAGGSGPASLTLPCLRHACVPVDFEEVHVSSNADEEDIRNAIMAIRRNRVALKGLVWLERTLVLGDWVDASSGLFALRCWDSSNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENMHTPDIGGQGTTSEAIQDVIRHIRVINGRAVEA

SEQ ID NO: 848541 - protein, 228 aa, Homo sapiens
MALKVATVAGSAAKAVLGPALLCRPWEVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMYVP

SEQ ID NO: 848542 - protein, 220 aa, Homo sapiens
MIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIINWGDGHLDSTAAGRSADRYPQRSLREPVTLMDNRHQHTMEVTRNYSSVIDIGE

SEQ ID NO: 848543 - protein, 97 aa, Homo sapiens
SGHPHATLSGRKQAPRPPELTVVPKGSKTSRPLALGRAPAGAPLYLPPGPREDPPVRDVAAGSARVEGLSSSSSILSPLPPHKHHSLNLLASLVCLI

SEQ ID NO: 848544 - protein, 190 aa, Homo sapiens
MEAETKTLPLENASILSEGSLQEGHRLWIGNLDPKITEYHLLKLLQKFGKVKQFDFLFHKSGALEGQPRGYCFVNFETKQEAEQAIQCLNGKLALSKKLVVRWAHAQVKRYDHNKNDKILPISLEPSSSTEPTQSNLSVTAKIKAIEAKLKMMAENPDAEYPAAPVYSYFKPPDKKRTTPYSRTAWKSRR

SEQ ID NO: 848545 - protein, 146 aa, Homo sapiens
MEAETKTLPLENASILSEGSLQEGHRLWIGNLDPKITEYHLLKLLQKFGKVKQFDFLFHKSGALEGQPRGYCFVNFETKQEAEQAIQCLNGKLALSKKLVVRWAHAQVKRYDHNKNDKILPISLEPSSSTEPTQSNLRGPQLTSLY

SEQ ID NO: 848546 - protein, 190 aa, Homo sapiens; identical to SEQ ID NO: 848544

SEQ ID NO: 848547 - protein, 190 aa, Homo sapiens; identical to SEQ ID NO: 848544

SEQ ID NO: 848548 - protein, 268 aa, Homo sapiens
MGSAKSVPVTPARPPPHNKHLARVADPRSPSAGILRTPIQVESSPQPGLPAGEQLEGLKHAQDSDPRSPTLGIARTPMKTSSGDPPSPLVKQLSEVFETEDSKSNLPPEPVLPPEAPLSSELDLPLGTQLSVEEQMPPWNQTEFPSKQVFSKEEARQPTETPVASQSSDKPSRDPETPRSSGSMRNRWKPNSSKVLGRSPLTILQDDNSPGTLTLRQGKRPSPLSENVSELKEGAILGTGRLLKTGGRAWEQGQDHDKENQHFPLVES

SEQ ID NO: 848549 - protein, 268 aa, Homo sapiens; identical to SEQ ID NO: 848548

SEQ ID NO: 848550 - protein, 195 aa, Homo sapiens
MGSAKSVPVTPARPPPHNKHLARVADPRSPSAGILRTPIQVESSPQPGLPAGEQLEGLKHAQDSDPRSPTLGIARTPMKTSSGDPPSPLVKQLSEVFETEDSKSNLPPEPVLPPEAPLSSELDLPLGTQLSVEEQMPPWNQTEFPSKQVFSKEEARQPTETPVASQSSDKPSRDPETPRSSGTESKARCREDKLG

SEQ ID NO: 848551 - protein, 133 aa, Homo sapiens
MPPWNQTEFPSKQVFSKEEARQPTETPVASQSSDKPSRDPETPRSSGSMRNRWKPNSSKVLGRSPLTILQDDNSPGTLTLRQGKRPSPLSENVSELKEGAILGTGRLLKTGGRAWEQGQDHDKENQHFPLVES

SEQ ID NO: 848552 - protein, 182 aa, Homo sapiens
MGSAKSVPVTPARPPPHNKHLARVADPRSPSAGILRTPIQVESSPQPGLPAGEQLEGLKHAQDSDPRSPTLGIARTPMKTSSGDPPSPLVKQLSEVFETEDSKSNLPPEPVLPPEAPLSSELDLPLGTQLSVEEQMPPWNQTEFPSKQVFSKEEARQPTETPVASQSSDKPSRDPETPRSSG

SEQ ID NO: 848553 - protein, 182 aa, Homo sapiens; identical to SEQ ID NO: 848552

SEQ ID NO: 848554 - protein, 268 aa, Homo sapiens; identical to SEQ ID NO: 848548

SEQ ID NO: 848555 - protein, 259 aa, Homo sapiens
MGSAKSVPVTPARPPPHNKHLARVADPRSPSAGILRTPIQVESSPQPGLPAGEQLEGLKHAQDSDPRSPTLGIARTPMKTSSGDPPSPLVKQLSEVFETEDSKSNLPPEPVLPPEAPLSSELDLPLGTQLSVEEQMPPWNQTEFPSKQVFSKEEARQPTETPVASQSSDKPSRDPETPRSSGSMRNRWKPNSSKVLGRSPLTILQDDNSPGTLTLRQVKEEKVQAVTRISNEEGGRPFYPDLPSSEQQLPPTHTLPFSG

SEQ ID NO: 848556 - protein, 195 aa, Homo sapiens; identical to SEQ ID NO: 848550

SEQ ID NO: 848557 - protein, 105 aa, Homo sapiens
MKTSSGDPPSPLVKQLSEVFETEDSKSNLPPEPVLPPEAPLSSELDLPLGTQLSVEEQMPPWNQTEFPSKQVFSKEEARQPTETPVASQSSDKPSRDPETPRSSG

SEQ ID NO: 848558 - protein, 201 aa, Homo sapiens
MVSWIISRLVVLIFGTLYPAYYSYKAVKSKDIKEYVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKGQGALSERLRSFSMQDLTTIRGDGAPAPSGPPPPGSGRASGKHGQPKMSRSASESASSSGTA

SEQ ID NO: 848559 - protein, 266 aa, Homo sapiens
TRRPDQTRPDQTRPDDQTRPDQTRPDQRPDQTRPDQTRPETRPDQTRPDQTRDQTRPDQTRPDQRPDQTRPDQTRPETRPDQTRPDQTRDQTRPDQTRPDQRPDQTRPDQTRPETRPDQTRPDQTRDQTRPDQTRPDQRPDQTRPDQTRPETRPDQTRPDQTRDQTRPDQTRPDQRPDQTRPDQTRPETRPDQTRPDQTRDQTRPDQTRPDQRPDQTRPDQTRPETRPDQTRPDQTRDQTRPDQTRPDQRPDQTRPDHIELTVSQL

SEQ ID NO: 848560 - protein, 201 aa, Homo sapiens; identical to SEQ ID NO: 848558

SEQ ID NO: 848561 - protein, 201 aa, Homo sapiens; identical to SEQ ID NO: 848558

SEQ ID NO: 848562 - protein, 518 aa, Homo sapiens
MAASMARRLWPLLTRRGFRPRGGCISNDSPRRSFTTEKRNRNLLYEYAREGYSALPQLDIERFCACPEEAAHALELRKGELRSADLPAIISTWQELRQLQEQIRSLEEEKAAVTEAVRALLANQDSGEVQQDPKYQGLRARGREIRKELVHLYPREAQLEEQFYLQALKLPNQTHPDVPVGDESQARVLHMVGDKPVFSFQPRGHLEIGEKLDIIRQKRLSHVSGHRSYYLRGAGALLQHGLVNFTFNKLLRRGFTPMTVPDLLRGAVFEGCGMTPNANPSQIYNIDPARFKDLNLAGTAEVGLAGYFMDHTVAFRDLPVRMVCSSTCYRAETNTGQEPRGLYRVHHFTKVEMFGVTGPGLEQSSQLLEEFLSLQMEILTELGLHFRVLDMPTQELGLPAYRKFDIEAWMPGRGRFGEVTSASNCTDFQSRRLHIMFQTEAGELQFAHTVNATACAVPRLLIALLESNQQKDGSVLVPPALQSYLGTDRITAPTHVPLQYIGPNQPRKPGLPGQPAVS

SEQ ID NO: 848563 - protein, 518 aa, Homo sapiens; identical to SEQ ID NO: 848562

SEQ ID NO: 848564 - protein, 539 aa, Homo sapiens
MAASMARRLWPLLTRRGFRPRGGCISNDSPRRSFTTEKRNRNLLYEYAREGYSALPQLDIERFCACPEEAAHALELRKGELRSADLPAIISTWQELRQLQEQIRSLEEEKAAVTEAVRALLANQDSGEVQQDPKYQGLRARGREIRKELVHLYPREAQLEEQFYLQALKLPNQTHPDVPVGDESQARVLHMVGDKPVFSFQPRGHLEIGEKLDIIRQKRLSHVSGHRSYYLRGAGALLQHGLVNFTFNKLLRRGFTPMTVPDLLRGAVFEGCGMTPNANPSQIYNIDPARFKDLNLAGTAEVGLAGYFMDHTVAFRDLPVRMVCSSTCYRAETNTGQEPRGLYRVHHFTKVEMFGVTGPGLEQSSQLLEEFLSLQMEILTELGLHFRVLDMPTQELGLPAYRKFDIEAWMPGRGRFGEVTSASNCTDFQSRRLHIMFQTEAGELQFAHTVNATACAVPRLLIALLESNQQKDGSVLVPPALQSYLGTDRITAPTHVPLQYIGPNQPRKPGLPGQPALHARAPGPRGPPLLCPCCLRVSH

SEQ ID NO: 848565 - protein, 420 aa, Homo sapiens
MSTTGALPVRIKVTLDEGVLTLSRAEPTCCCPQDPKYQGLRARGREIRKELVHLYPREAQLEEQFYLQALKLPNQTHPDVPVGDESQARVLHMVGDKPVFSFQPRGHLEIGEKLDIIRQKRLSHVSGHRSYYLRGAGALLQHGLVNFTFNKLLRRGFTPMTVPDLLRGAVFEGCGMTPNANPSQIYNIDPARFKDLNLAGTAEVGLAGYFMDHTVAFRDLPVRMVCSSTCYRAETNTGQEPRGLYRVHHFTKVEMFGVTGPGLEQSSQLLEEFLSLQMEILTELGLHFRVLDMPTQELGLPAYRKFDIEAWMPGRGRFGEVTSASNCTDFQSRRLHIMFQTEAGELQFAHTVNATACAVPRLLIALLESNQQKDGSVLVPPALQSYLGTDRITAPTHVPLQYIGPNQPRKPGLPGQPAVS

SEQ ID NO: 848566 - protein, 245 aa, Homo sapiens
MTPNANPSQIYNIDPARFKDLNLAGTAEVGLAGYFMDHTVAFRDLPVRMVCSSTCYRAETNTGQEPRGLYRVHHFTKVEMFGVTGPGLEQSSQLLEEFLSLQMEILTELGLHFRVLDMPTQELGLPAYRKFDIEAWMPGRGRFGEVTSASNCTDFQSRRLHIMFQTEAGELQFAHTVNATACAVPRLLIALLESNQQKDGSVLVPPALQSYLGTDRITAPTHVPLQYIGPNQPRKPGLPGQPAVS

SEQ ID NO: 848567 - protein, 518 aa, Homo sapiens; identical to SEQ ID NO: 848562

SEQ ID NO: 848568 - protein, 518 aa, Homo sapiens; identical to SEQ ID NO: 848562

SEQ ID NO: 848569 - protein, 510 aa, Homo sapiens
MAASMARRLWPLLTRRGFRPRGGCISNDSPRRSFTTEKRNRNLLYEYAREGYSALPQLDIERFCACPEEAAHALELRKGELRSADLPAIISTWQELRQLQEQIRSLEEEKAAVTEAVRALLANQDSGEVQQDPKYQGLRARGREIRKELVHLYPREAQLEEQFYLQALKLPNQTHPDVPVGDESQARVLHMVGDKPVFSFQPRGHLEIGEKLDIIRQKRLSHVSGHRSYYLRGAGALLQHGLVNFTFNKLLRRGFTPMTVPDLLRGAVFEGCGMTPNANPSQIYNIDPARFKDLNLAGTAEVGLAGYFMDHTVAFRDLPVRMVCSSTCYRAETNTGQEPRGLYRVHHFTKVEMFGVTGPGLEQSSQLLEEFLSLQMEILTELGLHFRVLDMPTQELGLPAYRKFDIEAWMPGRGRFGEVTSASNCTDFQSRRLHIMFQTEAGELQFAHTVRPAQPPARVPSPAASAALDPPTLAPPRAQLGVGASSEHGCLTGERHRLCCPPPSHRAPGE

SEQ ID NO: 848570 - protein, 539 aa, Homo sapiens; identical to SEQ ID NO: 848564

SEQ ID NO: 848571 - protein, 495 aa, Homo sapiens
MAASMARRLWPLLTRRGFRPRGGCISNDSPRRSFTTEKRNRNLLYEYAREGYSALPQLDIERFCACPEEAAHALELRKGELRSADLPAIISTWQELRQLQEQIRSLEEEKAAVTEAVRALLIRKELVHLYPREAQLEEQFYLQALKLPNQTHPDVPVGDESQARVLHMVGDKPVFSFQPRGHLEIGEKLDIIRQKRLSHVSGHRSYYLRGAGALLQHGLVNFTFNKLLRRGFTPMTVPDLLRGAVFEGCGMTPNANPSQIYNIDPARFKDLNLAGTAEVGLAGYFMDHTVAFRDLPVRMVCSSTCYRAETNTGQEPRGLYRVHHFTKVEMFGVTGPGLEQSSQLLEEFLSLQMEILTELGLHFRVLDMPTQELGLPAYRKFDIEAWMPGRGRFGEVTSASNCTDFQSRRLHIMFQTEAGELQFAHTVNATACAVPRLLIALLESNQQKDGSVLVPPALQSYLGTDRITAPTHVPLQYIGPNQPRKPGLPGQPAVS

SEQ ID NO: 848572 - protein, 166 aa, Homo sapiens [sequence omitted]

SEQ ID NO: 848573 - protein, 890 aa, Homo sapiens
MSANNSPPSAQKSVLPTAIPAVLPAASPCSSPKTGLSARLSNGSFSAPSLTNSRGSVHTVSFLLQIGLTRESVTIEAQELSLSAVKDLVCSIVYQKFPECGFFGMYDKILLFRHDMNSENILQLITSADEIHEGDLVEVVLSALATVEDFQIRPHTLYVHSYKAPTFCDYCGEMLWGLVRQGLKCEGCGLNYHKRCAFKIPNNCSGVRKRRLSNVSLPGPGLSVPRPLQPEYVALPSEESHVHQEPSKRIPSWSGRPIWMEKMVMCRVKVPHTFAVHSYTRPTICQYCKRLLKGLFRQGMQCKDCKFNCHKRCASKVPRDCLGEVTFNGEPSSLGTDTDIPMDIDNNDINSDSSRGLDDTEEPSPPEDKMFFLDPSDLDVERDEEAVKTISPSTSNNIPLMRVVQSIKHTKRKSSTMVKEGWMVHYTSRDNLRKRHYWRLDSKCLTLFQNESGSKYYKEIPLSEILRISSPRDFTNISQGSNPHCFEIITDTMVYFVGENNGDSSHNPVLAATGVGLDVAQSWEKAIRQALMPVTPQASVCTSPGQGKDHKDLSTSISVSNCQIQENVDISTVYQIFADEVLGSGQFGIVYGGKHRKTGRDVAIKVIDKMRFPTKQESQLRNEVAILQNLHHPGIVNLECMFETPERVFVVMEKLHGDMLEMILSSEKSRLPERITKFMVTQILVALRNLHFKNIVHCDLKPENVLLASAEPFPQVKLCDFGFARIIGEKSFRRSVVGTPAYLAPEVLRSKGYNRSLDMWSVGVIIYVSLSGTFPFNEDEDINDQIQNAAFMYPPNPWREISGEAIDLINNLLQVKMRKRYSVDKSLSHPWLQDYQTWLDLREFETRIGERYITHESDDARWEIHAYTHNLVYPKHFIMAPNPDDMEEDP

SEQ ID NO: 848574 - protein, 281 aa, Homo sapiens
MRFPTKQESQLRNEVAILQNLHHPGIVNLECMFETPERVFVVMEKLHGDMLEMILSSEKSRLPERITKFMVTQILVALRNLHFKNIVHCDLKPENVLLASAEPFPQVKLCDFGFARIIGEKSFRRSVVGTPAYLAPEVLRSKGYNRSLDMWSVGVIIYVSLSGTFPFNEDEDINDQIQNAAFMYPPNPWREISGEAIDLINNLLQVKMRKRYSVDKSLSHPWLQDYQTWLDLREFETRIGERYITHESDDARWEIHAYTHNLVYPKHFIMAPNPDDMEEDP

SEQ ID NO: 848575 - protein, 890 aa, Homo sapiens; identical to SEQ ID NO: 848573

SEQ ID NO: 848576 - protein, 480 aa, Homo sapiens [sequence omitted]

SEQ ID NO: 848577 - protein, 890 aa, Homo sapiens; identical to SEQ ID NO: 848573

SEQ ID NO: 848578 - protein, 890 aa, Homo sapiens; identical to SEQ ID NO: 848573

SEQ ID NO: 848579 - protein, 611 aa, Homo sapiens
MSANNSPPSAQKSVLPTAIPAVLPAASPCSSPKTGLSARLSNGSFSAPSLTNSRGSVHTVSFLLQIGLTRESVTIEAQELSLSAVKDLVCSIVYQKFPECGFFGMYDKILLFRHDMNSENILQLITSADEIHEGDLVEVVLSALATVEDFQIRPHTLYVHSYKAPTFCDYCGEMLWGLVRQGLKCEGCGLNYHKRCAFKIPNNCSGVRKRRLSNVSLPGPGLSVPRPLQPEYVALPSEESHVHQEPSKRIPSWSGRPIWMEKMVMCRVKVPHTFAVHSYTRPTICQYCKRLLKGLFRQGMQCKDCKFNCHKRCASKVPRDCLGEVTFNGEPSSLGTDTDIPMDIDNNDINSDSSRGLDDTEEPSPPEDKMFFLDPSDLDVERDEEAVKTISPSTSNNIPLMRVVQSIKHTKRKSSTMVKEGWMVHYTSRDNLRKRHYWRLDSKCLTLFQNESGSKYYKEIPLSEILRISSPRDFTNISQGSNPHCFEIITDTMVYFVGENNGDSSHNPVLAATGVGLDVAQSWEKAIRQALMPVTPQASVCTSPGQGKDHKDLSTSISVSNCQIQENVDISTVYQIFADEVLGSGQFGIVYGGKQLQPFAYCTHYFKNWKM

SEQ ID NO: 848580 - protein, 129 aa, Homo sapiens
GVLILPSSQQGTGRQHVGPVHSRDHPKLLGRCLSHPSVDSDPSWRCRAWRSRVGRRAFPKSLESHRQGTGRRWWLFRFSESHLIPILLVLRLGISVNLLIVNLAVCSLPKESALFRFSVESFLSIRDCY

SEQ ID NO: 848581 - protein, 68 aa, Homo sapiens
AAAYYYYYYYYYYSLEFKLLTMYGDMNLEANGTVSTTANSFWSLYRRTSEILQVRFQTTSKKQLLQIE

SEQ ID NO: 848582 - protein, 459 aa, Homo sapiens
MLRWLIGGGREPQGLAEKSPLQTIGEEQTQNPYTELLVLKAHHDIVRFLVQLDDYRFASAGDDGIVVVWNAQTGEKLLELNGHTQKITAIITFPSLESCEEKNQLILTASADRTVIVWDGDTTRQVQRISCFQSTVKCLTVLQRLDVWLSGGNDLCVWNRKLDLLCKTSHLSDTGISALVEIPKNCVVAAVGKELIIFRLVAPTEGSLEWDILEVKRLLDHQDNILSLINVNDLSFVTGSHVGELIIWDALDWTMQAYERNFWDPSPQLDTQQEIKLCQKSNDISIHHFTCDEENVFAAVGRGLYVYSLQMKRVIACQKTAHDSNVLHIARLPNRQLISCSEDGSVRIWELREKQQLAAEPVPTGFFNMWGFGRVSKQASQPVKKQQENATSCSLELIGDLIGHSSSVEMFLYFEDHGLVTCSADHLIILWKNGERESGLRSLRLFQKLEENGDLYLAV

SEQ ID NO: 848583 - protein, 140 aa, Homo sapiens [sequence omitted]

SEQ ID NO: 848584 - protein, 459 aa, Homo sapiens; identical to SEQ ID NO: 848582

SEQ ID NO: 848585 - protein, 438 aa, Homo sapiens
MLRWLIGGGREPQGLAEKSPLQTIGEEQTQNPYTELLVLKAHHDIVRFLVQLDDYRFASAGDDGIVVVWNAQTGEKLLELNGHTQKITAIITFPSLESCEEKNQLILTASADRTVIVWDGDTTRQVQRISCFQSTVKCLTVLQRLDVWLSGGNDLCVWNRKLDLLCKTSHLSDTVIFRLVAPTEGSLEWDILEVKRLLDHQDNILSLINVNDLSFVTGSHVGELIIWDALDWTMQAYERNFWDPSPQLDTQQEIKLCQKSNDISIHHFTCDEENVFAAVGRGLYVYSLQMKRVIACQKTAHDSNVLHIARLPNRQLISCSEDGSVRIWELREKQQLAAEPVPTGFFNMWGFGRVSKQASQPVKKQQENATSCSLELIGDLIGHSSSVEMFLYFEDHGLVTCSADHLIILWKNGERESGLRSLRLFQKLEENGDLYLAV

SEQ ID NO: 848586 - protein, 105 aa, Homo sapiens
MLRWLIGGGREPQGLAEKSPLQTIGEEQTQNPYTELLVLKAHHDIVRFLVQLDDYRFASAGDDGIVVVWNAQTGEKLLELNGHTQKITAIITFPSLESCEESVGW

SEQ ID NO: 848587 - protein, 459 aa, Homo sapiens; identical to SEQ ID NO: 848582

SEQ ID NO: 848588 - protein, 459 aa, Homo sapiens; identical to SEQ ID NO: 848582

SEQ ID NO: 848589 - protein, 238 aa, Homo sapiens
MLRWLIGGGREPQGLAEKSPLQTIGEEQTQNPYTELLVLKAHHDIVRFLVQLDDYRFASAGDDGIVVVWNAQTGEKLLELNGHTQKITAIITFPSLESCEEKNQLILTASADRTVIVWDGDTTRQVQRISCFQSTVKCLTVLQRLDVWLSGGNDLCVWNRKLDLLCKTSHLSDTGISALVEIPKNCVVAAVGKELIIFRLVAPTEGSLEWDILEVKRLLDHQDNILSLINVNDRGQNF

SEQ ID NO: 848590 - protein, 459 aa, Homo sapiens; identical to SEQ ID NO: 848582

SEQ ID NO: 848591 - protein, 459 aa, Homo sapiens; identical to SEQ ID NO: 848582

SEQ ID NO: 848592 - protein, 459 aa, Homo sapiens; identical to SEQ ID NO: 848582

SEQ ID NO: 848593 - protein, 299 aa, Homo sapiens
MFGFLVGMTCVCGTGISALVEIPKNCVVAAVGKELIIFRLVAPTEGSLEWDILEVKRLLDHQDNILSLINVNDLSFVTGSHVGELIIWDALDWTMQAYERNFWDPSPQLDTQQEIKLCQKSNDISIHHFTCDEENVFAAVGRGLYVYSLQMKRVIACQKTAHDSNVLHIARLPNRQLISCSEDGSVRIWELREKQQLAAEPVPTGFFNMWGFGRVSKQASQPVKKQQENATSCSLELIGDLIGHSSSVEMFLYFEDHGLVTCSADHLIILWKNGERESGLRSLRLFQKLEENGDLYLAV

SEQ ID NO: 848594 - protein, 251 aa, Homo sapiens
MLRWLIGGGREPQGLAEKSPLQTIDLSFVTGSHVGELIIWDALDWTMQAYERNFWDPSPQLDTQQEIKLCQKSNDISIHHFTCDEENVFAAVGRGLYVYSLQMKRVIACQKTAHDSNVLHIARLPNRQLISCSEDGSVRIWELREKQQLAAEPVPTGFFNMWGFGRVSKQASQPVKKQQENATSCSLELIGDLIGHSSSVEMFLYFEDHGLVTCSADHLIILWKNGERESGLRSLRLFQKLEENGDLYLAV

SEQ ID NO: 848595 - protein, 459 aa, Homo sapiens; identical to SEQ ID NO: 848582

SEQ ID NO: 848596 - protein, 356 aa, Homo sapiens
MFPSSQIPSWKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 848597 - protein, 755 aa, Homo sapiens
MEAVIEKECSALGGLFQTIISDMKGSYPVWEDFINKAGKLQSQLRTTVVAAAAFLDAFQKVADMATNTRGGTREIGSALTRMCMRHRSIEAKLRQFSSALIDCLINPLQEQMEEWKKVANQLDKDHAKEYKKARQEIKKKSSDTLKLQKKAKKGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQLSNGFSHYSLSSESHVGPTGAGLFPHCLPASRLLPRVTSVHLPDYAHYYTIGPGMFPSSQIPSWKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 848598 - protein, 755 aa, Homo sapiens; identical to SEQ ID NO: 848597

SEQ ID NO: 848599 - protein, 755 aa, Homo sapiens; identical to SEQ ID NO: 848597

SEQ ID NO: 848600 - protein, 611 aa, Homo sapiens
RGVGRALCAGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQLSNGFSHYSLSSESHVGPTGAGLFPHCLPASRLLPRVTSVHLPDYAHYYTIGPGMFPSSQIPSWKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 848601 - protein, 557 aa, Homo sapiens
MIGSWRRPRTRAHVYRTLAGRPHPLLPVPCLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQLSNGFSHYSLSSESHVGPTGAGLFPHCLPASRLLPRVTSVHLPDYAHYYTIGPGMFPSSQIPSWKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 848602 - protein, 755 aa, Homo sapiens; identical to SEQ ID NO: 848597

SEQ ID NO: 848603 - protein, 755 aa, Homo sapiens; identical to SEQ ID NO: 848597

SEQ ID NO: 848604 - protein, 755 aa, Homo sapiens; identical to SEQ ID NO: 848597

SEQ ID NO: 848605 - protein, 155 aa, Homo sapiens [sequence omitted]

SEQ ID NO: 848606 - protein, 690 aa, Homo sapiens
MEAVIEKECSALGGLFQTIISDMKGSYPVWEDFINKAGKLQSQLRTTVVAAAAFLDAFQKVADMATNTRGGTREIGSALTRMCMRHRSIEAKLRQFSSALIDCLINPLQEQMEEWKKVANQLDKDHAKEYKKARQEIKKKSSDTLKLQKKAKKGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 848607 - protein, 529 aa, Homo sapiens
RGVGRALCAGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 848608 - protein, 755 aa, Homo sapiens; identical to SEQ ID NO: 848597

SEQ ID NO: 848609 - protein, 755 aa, Homo sapiens; identical to SEQ ID NO: 848597

SEQ ID NO: 848610 - protein, 158 aa, Homo sapiens
MCSCPISSPGHIKGLGQEETPVRSADLVFKERMPACNTHGEGHFLAPPAKYLQTLGRRLHSQHRTSLNSFRISDHHHVQVSECRPTTRDGFHPPALLQIHAAQQARAWREQLLSTAPLEPSPRSRSSPVLMMPSCCWPETVSQLQQDDTGFRNMWLSP

SEQ ID NO: 848611 - protein, 96 aa, Homo sapiens
ASGRVARANQVKGEWRRSGGNSYGSGGASYNPGSHGGYGGGSGGGSSYQGKQGGYSQSNYNSPGSGQNYSGPPSSYQSSQGGYGRNADHSMNYQYR

SEQ ID NO: 848612 - protein, 562 aa, Homo sapiens
MSRMVVLQLEATGEVQAGLSLCGCPTHCVTPQRQPWGLGLAELSWRPAIVLIQSHLAILSVEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAEQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSQFYSNGGHSGNASGGGGGGGGGSSGYGSYYQGDNYNSPVPPKHAGKKQPHGGQQKPSYGSGYQSHQGQQQSYNQSPYSNYGPPQGKQKGYNHGQGSYSYSNSYNSPGGGGGSDYNYESKFNYSGSGGRSGGNSYGSGGASYNPGSHGGYGGGSGGGSSYQGKQGGYSQSNYNSPGSGQNYSGPPSSYQSSQGGYGRNADHSMNYQYR

SEQ ID NO: 848613 - protein, 118 aa, Homo sapiens
NGVGRRRRTCRPGSVNRRGLVVCTTQALQWAGFPTLFLLLGKQRGPSGWSLVLREGPVQASRHFTHAQRRLVPGPLGCVDPVSHQAPGSHHLQRGLQRPFWSWGTHHKIGFFCSPILV

SEQ ID NO: 848614 - protein, 158 aa, Homo sapiens; identical to SEQ ID NO: 848610

SEQ ID NO: 848615 - protein, 158 aa, Homo sapiens; identical to SEQ ID NO: 848610

SEQ ID NO: 848616 - protein, 150 aa, Homo sapiens
MARVRGWVFEETPVRSADLVFKERMPACNTHGEGHFLAPPAKYLQTLGRRLHSQHRTSLNSFRISDHHHVQVSECRPTTRDGFHPPALLQIHAAQQARAWREQLLSTAPLEPSPRSRSSPVLMMPSCCWPETVSQLQQDDTGFRNMWLSP

SEQ ID NO: 848617 - protein, 126 aa, Homo sapiens
MPACNTHGEGHFLAPPAKYLQTLGRRLHSQHRTSLNSFRISDHHHVQVSECRPTTRDGFHPPALLQIHAAQQARAWREQLLSTAPLEPSPRSRSSPVLMMPSCCWPETVSQLQQDDTGFRNMWLSP

SEQ ID NO: 848618 - protein, 591 aa, Homo sapiens
GHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAEQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSQFYSNGGHSGNASGGGGGGGGGSSGYGSYYQGDNYNSPVPPKHAGKKQPHGGQQKPSYGSGYQSHQGQQQSYNQSPYSNYGPPQGKQKGYNHGQGSYSYSNSYNSPGGGGGSDYNYESKFNYSGSGGRSGGNSYGSGGASYNPGSHGGYGGGSGGGSSYQGKQGGYSQSNYNSPGSGQNYSGPPSSYQSSQGGYGRNADHSMNYQYR

SEQ ID NO: 848619 - protein, 562 aa, Homo sapiens; identical to SEQ ID NO: 848612

SEQ ID NO: 848620 - protein, 158 aa, Homo sapiens; identical to SEQ ID NO: 848610

SEQ ID NO: 848621 - protein, 158 aa, Homo sapiens; identical to SEQ ID NO: 848610

SEQ ID NO: 848622 - protein, 562 aa, Homo sapiens; identical to SEQ ID NO: 848612

SEQ ID NO: 848623 - protein, 562 aa, Homo sapiens; identical to SEQ ID NO: 848612

SEQ ID NO: 848624 - protein, 562 aa, Homo sapiens; identical to SEQ ID NO: 848612

SEQ ID NO: 848625 - protein, 265 aa, Homo sapiens
MDGPAIITQVTNPKEDEGRLPGAGEKASQCNVSLKKQRSRSILSSFFCCFRDYNVEAPPPSSPSVLPPLVEENGGLQKPPAKYLLPEVTVLDYGKKCVVIDLDETLVHSSFKPISNADFIVPVEIDGTIHQVYVLKRPHVDEFLQRMGQLFECVLFTASLAKYADPVADLLDRWGVFRARLFRESCVFHRGNYVKDLSRLGRELSKVIIVDNSPASYIFHPENAVPVQSWFDDMTDTELLDLIPFFEGLSREDDVYSMLHRLCNR

SEQ ID NO: 848626 - protein, 276 aa, Homo sapiens
MDGPAIITQVTNPKEDEGRLPGAGEKASQCNVSLKKQRSRSILSSFFCCFRDYNVEAPPPSSPSVLPPLVEENGGLQKGDQRQVIPIPSPPAKYLLPEVTVLDYGKKCVVIDLDETLVHSSFKPISNADFIVPVEIDGTIHQVYVLKRPHVDEFLQRMGQLFECVLFTASLAKYADPVADLLDRWGVFRARLFRESCVFHRGNYVKDLSRLGRELSKVIIVDNSPASYIFHPENAVPVQSWFDDMTDTELLDLIPFFEGLSREDDVYSMLHRLCNR

SEQ ID NO: 848627 - protein, 276 aa, Homo sapiens; identical to SEQ ID NO: 848626

SEQ ID NO: 848628 - protein, 119 aa, Homo sapiens
MGQLFECVLFTASLAKYADPVADLLDRWGVFRARLFRESCVFHRGNYVKDLSRLGRELSKVIIVDNSPASYIFHPENAVPVQSWFDDMTDTELLDLIPFFEGLSREDDVYSMLHRLCNR

SEQ ID NO: 848629 - protein, 297 aa, Homo sapiens
MDGPAIITQVTNPKEDEGRLPGAGEKASQCNVSLKKQRSRSILSSFFCCFRDYNVEAPPPSSPSVLPPLVEENGGLQKGDQRQVIPIPSPPAKYLLPEVTVLDYGKKCVVIDLDETLVHSSFKPISNADFIVPVEIDGTIHQVYVLKRPHVDEFLQRMGQLFECVLFTASLAKYADPVADLLDRWGVFRARLFRESCVFHRGNYVKDLSRLGRELSKVIIVDNSPASYIFHPENAVPVQSWFDDMTDTELLDLIPFFEGLSREDDVYSMLHRLCNSWIHMELFGNFPCCYRAATKWN

SEQ ID NO: 848630 - protein, 334 aa, Homo sapiens
MDGPAIITQVTNPKEDEGRLPGAGEKASQCNVSLKKQRSRSILSSFFCCFRDYNVEAPPPSSPSVLPPLVEENGGLQKGDQRQVIPIPSPPAKYLLPEVTVLDYGKKCVVIDLDETLVHSSFKPISNADFIVPVEIDGTIHQVYVLKRPHVDEFLQRMGQLFECVLFTASLAKYADPVADLLDRWGVFRARLFRESCVFHRGNYVKDLSRLGRELSKVIIVDNSPASYIFHPENALDTHGAVWEFSLLLPRCHQMELTSGCYTVLCHCAYAQNMLTAKLQTRTGSETEVSHPIAASTTCNPFLALATEGYKGKRTTAPLRCSMDFKLQSVSDPV

SEQ ID NO: 848631 - protein, 276 aa, Homo sapiens; identical to SEQ ID NO: 848626

SEQ ID NO: 848632 - protein, 307 aa, Homo sapiens
MDGPAIITQVTNPKEDEGRLPGAGEKASQCNVSLKKQRSRSILSSFFCCFRDYNVEAPPPSSPSVLPPLVEENGGLQKGDQRQVIPIPSPPAKYLLPEVTVLDYGKKCVVIDLDETLVHSSFKPISNADFIVPVEIDGTIHQVYVLKRPHVDEFLQRMGQLFECVLFTASLAKYADPVADLLDRWGVFRARLFRESCVFHRGNYVKDLSRLGRELSKVIIVDNSPASYIFHPENAVPVQSWFDDMTDTELLDLIPFFEGLSREDDVYSMLHRLCNSNEASCQLHPPNSTLVCGLLCEYSEGKSFSAD

SEQ ID NO: 848633 - protein, 276 aa, Homo sapiens; identical to SEQ ID NO: 848626

SEQ ID NO: 848634 - protein, 328 aa, Homo sapiens
MDGPAIITQVTNPKEDEGRLPGAGEKDSLSEKGKKTSGRRIRKLSTHLGGRCNPRYKREGGQPGAVVHAYNPSTLGGQASQCNVSLKKQRSRSILSSFFCCFRDYNVEAPPPSSPSVLPPLVEENGGLQKGDQRQVIPIPSPPAKYLLPEVTVLDYGKKCVVIDLDETLVHSSFKPISNADFIVPVEIDGTIHQVYVLKRPHVDEFLQRMGQLFECVLFTASLAKYADPVADLLDRWGVFRARLFRESCVFHRGNYVKDLSRLGRELSKVIIVDNSPASYIFHPENAVPVQSWFDDMTDTELLDLIPFFEGLSREDDVYSMLHRLCNR

SEQ ID NO: 848635 - protein, 250 aa, Homo sapiens
MMAVCGERTRETSQCNVSLKKQRSRSILSSFFCCFRDYNVEAPPPSSPSVLPPLVEENGGLQKPPAKYLLPEVTVLDYGKKCVVIDLDETLVHSSFKPISNADFIVPVEIDGTIHQVYVLKRPHVDEFLQRMGQLFECVLFTASLAKYADPVADLLDRWGVFRARLFRESCVFHRGNYVKDLSRLGRELSKVIIVDNSPASYIFHPENAVPVQSWFDDMTDTELLDLIPFFEGLSREDDVYSMLHRLCNR

SEQ ID NO: 848636 - protein, 107 aa, Homo sapiens
MGWVYADPVADLLDRWGVFRARLFRESCVFHRGNYVKDLSRLGRELSKVIIVDNSPASYIFHPENAVPVQSWFDDMTDTELLDLIPFFEGLSREDDVYSMLHRLCNR

SEQ ID NO: 848637 - protein, 95 aa, Homo sapiens
LNLNKGTNKIMMITMMTPVVLTKESAQSPGTRLGEEQPPALDAVLLPPPCTVFQVPVQSWFDDMTDTELLDLIPFFEGLSREDDVYSMLHRLCNR

SEQ ID NO: 848638 - protein, 276 aa, Homo sapiens; identical to SEQ ID NO: 848626

SEQ ID NO: 848639 - protein, 128 aa, Homo sapiens
MQILRFSVYRSQPREHLFFTFLLKIHWGGIKFTPKKFAWAKSLQVPSENKILMIFFFFWLLGRDFQHSFTISRYVPSAHTLNFLIWFVSSSRKNGALPLLLYFKELLCLNHSSPAKKRQDERLEHVLP

SEQ ID NO: 848640 - protein, 128 aa, Homo sapiens; identical to SEQ ID NO: 848639

SEQ ID NO: 848641 - protein, 362 aa, Homo sapiens
MGNHTWEGCHVDSRVDHLFPPSLYIFVIGVGLPTNCLALWAAYRQVQQRNELGVYLMNLSIADLLYICTLPLWVDYFLHHDNWIHGPGSCKLFGFIFYTNIYISIAFLCCISVDRYLAVAHPLRFARLRRVKTAVAVSSVVWATELGANSAPLFHDELFRDRYNHTFCFEKFPMEGWVAWMNLYRVFVGFLFPWALMLLSYRGILRAVRGSVSTERQEKAKIKRLALSLIAIVLVCFAPYHVLLLSRSAIYLGRPWDCGFEERVFSAYHSSLAFTSLNCVADPILYCLVNEGARSDVAKALHNLLRFLASDKPQEMANASLTLETPLTSKRNSTAKAMTGSWAATPPSQGDQVQLKMLPPAQ

SEQ ID NO: 848642 - protein, 218 aa, Homo sapiens
PACIGDVTVNSKQLDKDSPVSAFTVNRCYAVAQEGTYFDGSGYAALVKEGYKVQSDVNITLEFRTSSQNGVLLGISTAKVDAIGLELVDGKVLFHVNNGAGRITAAYEPKTATVLCDGKWHTLQANKSKHRITLIVDGNAVGAESPHTQSTSVDTNNPIYVGGYPAGVKQKCLRSQTSFRGCLRKLALIKSPQVQSFDFSRAFELHGVFLHSCPGTES

SEQ ID NO: 848643 - protein, 93 aa, Homo sapiens
TNRFQENAVEITRQTNESLLILRAIPEGIRDKGAKTKELATSASQSAVSTLRDVAGLSQELLNTSASLSRVNTTLRAFELHGVFLHSCPGTES

SEQ ID NO: 848644 - protein, 218 aa, Homo sapiens; identical to SEQ ID NO: 848642

SEQ ID NO: 848645 - protein, 584 aa, Homo sapiens
MSVRYSSSKHYSSSRSGGGGGGGGCGGGGGVSSLRISSSKGSLGGGFSSGGFSGGSFSRGSSGGGCFGGSSGGYGGLGGFGGGSFRGSYGSSSFGGSYGGSFGGGSFGGGSFGGGSFGGGGFGGGGFGGGFGGGFGGDGGLLSGNEKVTMQNLNDRLASYLDKVRALEESNYELEGKIKEWYEKHGNSHQGEPRDYSKYYKTIDDLKNQILNLTTDNANILLQIDNARLAADDFRLKYENEVALRQSVEADINGLRRVLDELTLTKADLEMQIESLTEELAYLKKNHEEEMKDLRNVSTGDVNVEMNAAPGVDLTQLLNNMRSQYEQLAEQNRKDAEAWFNEKSKELTTEIDNNIEQISSYKSEITELRRNVQALEIELQSQLALKQSLEASLAETEGRYCVQLSQIQAQISALEEQLQQIRAETECQNTEYQQLLDIKIRLENEIQTYRSLLEGEGSSGGGGRGGGSFGGGYGGGSSGGGSSGGGYGGGHGGSSGGGYGGGSSGGGSSGGGYGGGSSSGGHGGSSSGGYGGGSSGGGGGGYGGGSSGGGSSSGGGYGGGSSSGGHKSSSSGSVGESSSKGPRY

SEQ ID NO: 848646 - protein, 420 aa, Homo sapiens
AAAAGPRRRGHGPPRGGPGHHGNSHQGEPRDYSKYYKTIDDLKNQILNLTTDNANILLQIDNARLAADDFRLKYENEVALRQSVEADINGLRRVLDELTLTKADLEMQIESLTEELAYLKKNHEEEMKDLRNVSTGDVNVEMNAAPGVDLTQLLNNMRSQYEQLAEQNRKDAEAWFNEKSKELTTEIDNNIEQISSYKSEITELRRNVQALEIELQSQLALKQSLEASLAETEGRYCVQLSQIQAQISALEEQLQQIRAETECQNTEYQQLLDIKIRLENEIQTYRSLLEGEGSSGGGGRGGGSFGGGYGGGSSGGGSSGGGYGGGHGGSSGGGYGGGSSGGGSSGGGYGGGSSSGGHGGSSSGGYGGGSSGGGGGGYGGGSSGGGSSSGGGYGGGSSSGGHKSSSSGSVGESSSKGPRY

SEQ ID NO: 848647 - protein, 384 aa, Homo sapiens
LVPVRKIGIILNLTTDNANILLQIDNARLAADDFRLKYENEVALRQSVEADINGLRRVLDELTLTKADLEMQIESLTEELAYLKKNHEEEMKDLRNVSTGDVNVEMNAAPGVDLTQLLNNMRSQYEQLAEQNRKDAEAWFNEKSKELTTEIDNNIEQISSYKSEITELRRNVQALEIELQSQLALKQSLEASLAETEGRYCVQLSQIQAQISALEEQLQQIRAETECQNTEYQQLLDIKIRLENEIQTYRSLLEGEGSSGGGGRGGGSFGGGYGGGSSGGGSSGGGYGGGHGGSSGGGYGGGSSGGGSSGGGYGGGSSSGGHGGSSSGGYGGGSSGGGGGGYGGGSSGGGSSSGGGYGGGSSSGGHKSSSSGSVGESSSKGPRY

SEQ ID NO: 848648 - protein, 584 aa, Homo sapiens; identical to SEQ ID NO: 848645

SEQ ID NO: 848649 - protein, 546 aa, Homo sapiens
MSVRYSSSKHYSSSRSGGGGGGGGCGGGGGVSSLRISSSKGSLGGGFSSGGFSGGSFSRGSSGGGCFGGSSGGYGGLGGFGGGSFRGSYGSSSFGGSYGGSFGGGSFGGGSFGGGSFGGGGFGGGGFGGGFGGGFGGDGGLLSGNEKVTMQNLNDRLASYLDKVRALEESNYELEGKIKEWYEKHGNSHQGEPRDYSKYYKTIDDLKNQILNLTTDNANILLQIDNARLAADDFRLKYENEVALRQSVEADINGLRRVLDELTLTKADLEMQIESLTEELAYLKKNHEEEMKDLRNVSTGDVNVEMNAAPGVDLTQLLNNMRSQYEQLAEQNRKDAEAWFNEKSKELTTEIDNNIEQISSYKSEITELRRNVQALEIELQSQLALKQSLEASLAETEGRYCVQLSQIQAQISALEEQLQQIRAETECQNTEYQQLLDIKIRLENEIQTYRSLLEGEGSSGGGGRGGGSFGGGYGGGSSGGGSSGGGYGGGHGGSSGGGYGGGSSGGGSSGGGSSSGGGYGGGSSSGGHKSSSSGSVGESSSKGPRY

SEQ ID NO: 848650 - protein, 518 aa, Homo sapiens
MSVRYSSSKHYSSSRSGGGGGGGGCGGGGGVSSLRISSSKGSLGGGFSSGGFSGGSFSRGSSGGGCFGGSSGGYGGLGGFGGGSFRGSYGSSSFGGSYGGSFGGGSFGGGSFGGGSFGGGGFGGGGFGGGFGGGFGGDGGLLSGNEKVTMQNLNDRLASYLDKVRALEESNYELEGKIKEWYEKHGNSHQGEPRDYSKYYKTIDDLKNQILNLTTDNANILLQIDNARLAADDFRLKYENEVALRQSVEADINGLRRVLDELTLTKADLEMQIESLTEELAYLKKNHEEEMKDLRNVSTGDVNVEMNAAPGVDLTQLLNNMRSQYEQLAEQNRKDAEAWFNEKSKELTTEIDNNIEQISSYKSEITELRRNVQALEIELQSQLALKQSLEASLAETEGRYCVQLSQIQAQISALEEQLQQIRAETECQNTEYQQLLDIKIRLENEIQTYRSLLEGEGSSGGGGRGGGSFGGGYGGGSSGGGSSGGLRRRQQLRRRIRRRQLQRRPQVLLFRVRGRVFI

SEQ ID NO: 848651 - protein, 581 aa, Homo sapiens
MSVRYSSSKHYSSSRSGGGGGGGGCGGGGGVSSLRISSSKGSLGGGFSSGGFSGGSFSRGSSGGGCFGGSSGGYGGLGGFGGGSFRGSYGSSSFGGSYGGSFGGGSFGGGSFGGGSFGGGGFGGGGFGGGFGGGFGGDGGLLSGNEKVTMQNLNDRLASYLDKVRALEESNYELEGKIKEWYEKHGNSHQGEPRDYSKYYKTIDDLKNQILNLTTDNANILLQIDNARLAADDFRLKYENEVALRQSVEADINGLRRVLDELTLTKADLEMQIESLTEELAYLKKNHEEEMKDLRNVSTGDVNVEMNAAPGVDLTQLLNNMRSQYEQLAEQNRKDAEAWFNEKSKELTTEIDNNIEQISSYKSEITELRRNVQALEIELQSQLALKQSLEASLAETEGRYCVQLSQIQAQISALEEQLQQIRAETECQNTEYQQLLDIKIRLENEIQTYRSLLEGEGSSGGGGRGGGSFGGGYGGGSSGGGSSGGGYGGGHGGSSGGGYGGGSSGGGSSGGGYGGGSSSGGHKSSSSGSVGESSSKGPRRSAETSWDTNKTRVIKTIIEEVAPDGRVLSSMVESETKKHYY

SEQ ID NO: 848652 - protein, 549 aa, Homo sapiens
MSVRYSSSKHYSSSRSGGGGGGGGCGGGGGVSSLRISSSKGSLGGGFSSGGFSGGSFSRGSSGGGCFGGSSGGYGGLGGFGGGSFRGSYGSSSFGGSYGGSFGGGSFGGGSFGGGSFGGGGFGGGGFGGGFGGGFGGDGGLLSGNEKVTMQNLNDRLASYLDKVRALEESNYELEGKIKEWYEKHGNSHQGEPRDYSKYYKTIDDLKNQILNLTTDNANILLQIDNARLAADDFRLKYENEVALRQSVEADINGLRRVLDELTLTKADLEMQIESLTEELAYLKKNHEEEMKDLRNVSTGDVNVEMNAAPGVDLTQLLNNMRSQYEQLAEQNRKDAEAWFNEKSKELTTEIDNNIEQISSYKSEITELRRNVQALEIELQSQLALKQSLEASLAETEGRYCVQLSQIQAQISALEEQLQQIRAETECQNTEYQQLLDIKIRLENEIQTYRSLLEGEGSSGGGGRGGGSFGGGATGAAAPAAAAAPAADTAAAAPAEATSPPLPGPWASLHLRDQDTNKTRVIKTIIEEVAPDGRVLSSMVESETKKHYY

SEQ ID NO: 848653 - protein, 578 aa, Homo sapiens
MSVRYSSSKHYSSSRSGGGGGGGGCGGGGGVSSLRISSSKGSLGGGFSSGGFSGGSFSRGSSGGGCFGGSSGGYGGLGGFGGGSFRGSYGSSSFGGSYGGSFGGGSFGGGSFGGGSFGGGGFGGGGFGGGFGGGFGGDGGLLSGNEKVTMQNLNDRLASYLDKVRALEESNYELEGKIKEWYEKHGNSHQGEPRDYSKYYKTIDDLKNQILNLTTDNANILLQIDNARLAADDFRLKYENEVALRQSVEADINGLRRVLDELTLTKADLEMQIESLTEELAYLKKNHEEEMKDLRNVSTGDVNVEMNAAPGVDLTQLLNNMRSQYEQLAEQNRKDAEAWFNEKSKELTTEIDNNIEQISSYKSEITELRRNVQALEIELQSQLALKQSLEASLAETEGRYCVQLSQIQAQISALEEQLQQIRAETECQNTEYQQLLDIKIRLENEIQTYRSLLEGEGSSGGGGRGGGSFGGGYGGGSSGGGSSGGWPLLLALPAPAATPQCGRHPIHHYGITSSDQIHIYVRGTQSDDRNDERGQLTNDWTGTPGEGDTDTGTEQNERNAKNERRTQVATAIKKEEQM

SEQ ID NO: 848654 - protein, 174 aa, Homo sapiens
RHHTQLNKEVTKPQKNPFQKQSLEASLAETEGRYCVQLSQIQAQISALEEQLQQIRAETECQNTEYQQLLDIKIRLENEIQTYRSLLEGEGSSGGGGRGGGSFGGGYGGGSSGGGSSGGGYGGGHGGSSGGGYGGGSSGGGSSGGGYGGGSSSGGHKSSSSGSVGESSSKGPRY

SEQ ID NO: 848655 - protein, 310 aa, Homo sapiens
MSVRYSSSKHYSSSRSGGGGGGGGCGGGGGVSSLRISSSKGSLGGGFSSGGFSGGSFSRGSSGGGCFGGSSGGYGGLGGFGGGSFRGSYGSSSFGGSYGGSFGGGSFGGGSFGGGSFGGGGFGGGGFGGGFGGGFGGDGGLLSGNEKVTMQNLNDRLASYLDKVRALEESNYELEGKIKEWYEKHGNSHQGEPRDYSKYYKTIDDLKNQILNLTTDNANILLQIDNARLAADDFRLKYENEVALRQSVEADINGLRRVLDELTLTKADLEMQIESLTEELAYLKKNHEEEMKDLRNVSTGDVNVEMNAAP

SEQ ID NO: 848656 - protein, 584 aa, Homo sapiens; identical to SEQ ID NO: 848645

SEQ ID NO: 848657 - protein, 584 aa, Homo sapiens; identical to SEQ ID NO: 848645

SEQ ID NO: 848658 - protein, 393 aa, Homo sapiens
LVPVRKIGIKPSMTLNNQILNLTTDNANILLQIDNARLAADDFRLKYENEVALRQSVEADINGLRRVLDELTLTKADLEMQIESLTEELAYLKKNHEEEMKDLRNVSTGDVNVEMNAAPGVDLTQLLNNMRSQYEQLAEQNRKDAEAWFNEKSKELTTEIDNNIEQISSYKSEITELRRNVQALEIELQSQLALKQSLEASLAETEGRYCVQLSQIQAQISALEEQLQQIRAETECQNTEYQQLLDIKIRLENEIQTYRSLLEGEGSSGGGGRGGGSFGGGYGGGSSGGGSSGGGYGGGHGGSSGGGYGGGSSGGGSSGGGYGGGSSSGGHGGSSSGGYGGGSSGGGGGGYGGGSSGGGSSSGGGYGGGSSSGGHKSSSSGSVGESSSKGPRY

SEQ ID NO: 848659 - protein, 625 aa, Homo sapiens
MSVRYSSSKHYSSSRSGGGGGGGGCGGGGGVSSLRISSSKGSLGGGFSSGGFSGGSFSRGSSGGGCFGGSSGGYGGLGGFGGGSFRGSYGSSSFGGSYGGSFGGGSFGGGSFGGGSFGGGGFGGGGFGGGFGGGFGGDGGLLSGNEKVTMQNLNDRLASYLDKVRALEESNYELEGKIKEWYEKHGNSHQGEPRDYSKYYKTIDDLKNQILNLTTDNANILLQIDNARLAADDFRLKYENEVALRQSVEADINGLRRVLDELTLTKADLEMQIESLTEELAYLKKNHEEEMKDLRNVSTGDVNVEMNAAPGVDLTQLLNNMRSQYEQLAEQNRKDAEAWFNEKSKELTTEIDNNIEQISSYKSEITELRRNVQALEIELQSQLALKQSLEASLAETEGRYCVQLSQIQAQISALEEQLQQIRAETECQNTEYQQLLDIKIRLENEIQTYRSLLEGEGSSGGGGRGGGSFGGGYGGGSSGGGSSGGGYGGGHGGSSGGGYGGGSSGGGSSGGGYGGGSSSGGHGGSSSGGYGGGSSGGGGGGYGGGSSGGGSSSGGGYGGGSSSGGHKSSSSGSVGESSSKGPRRSAETSWDTNKTRVIKTIIEEVAPDGRVLSSMVESETKKHYY

SEQ ID NO: 848660 - protein, 540 aa, Homo sapiens
MSVRYSSSKHYSSSRSGGGGGGGGCGGGGGVSSLRISSSKGSLGGGFSSGGFSGGSFSRGSSGGGCFGGSSGGYGGLGGFGGGSFRGSYGSSSFGGSYGGSFGGGSFGGGSFGGGSFGGGGFGGGGFGGGFGGGFGGDGGLLSGNEKVTMQNLNDRLASYLDKVRALEESNYELEGKIKEWYEKHGNSHQGEPRDYSKYYKTIDDLKNQILNLTTDNANILLQIDNARLAADDFRLKYENEVALRQSVEADINGLRRVLDELTLTKADLEMQIESLTEELAYLKKNHEEEMKDLRNVSTGDVNVEMNAAPGVDLTQLLNNMRSQYEQLAEQNRKDAEAWFNEKSKELTTEIDNNIEQISSYKSEITELRRNVQALEIELQSQLALKQSLEASLAETEGRYCVQLSQIQAQISALEEQLQQIRAETECQNTEYQQLLDIKIRLENEIQTYRSLLEGEGSSGGGGRGGGSFGGGYGGGSSGGGSSGGGYGGGHGGSSGGGYGGGSSGGGSSGGGYGGGSSSGGHKSSSSGSVGESSSKGPRY

SEQ ID NO: 848661 - protein, 549 aa, Homo sapiens; identical to SEQ ID NO: 848652

SEQ ID NO: 848662 - protein, 518 aa, Homo sapiens; identical to SEQ ID NO: 848650

SEQ ID NO: 848663 - protein, 528 aa, Homo sapiens
MSVRYSSSKHYSSSRSGGGGGGGGCGGGGGVSSLRISSSKGSLGGGFSSGGFSGGSFSRGSSGGGCFGGSSGGYGGLGGFGGGSFRGSYGSSSFGGSYGGSFGGGSFGGGSFGGGSFGGGGFGGGGFGGGFGGGFGGDGGLLSGNEKVTMQNLNDRLASYLDKVRALEESNYELEGKIKEWYEKHGNSHQGEPRDYSKYYKTIDDLKNQILNLTTDNANILLQIDNARLAADDFRLKYENEVALRQSVEADINGLRRVLDELTLTKADLEMQIESLTEELAYLKKNHEEEMKDLRNVSTGDVNVEMNAAPGVDLTQLLNNMRSQYEQLAEQNRKDAEAWFNEKSKELTTEIDNNIEQISSYKSEITELRRNVQALEIELQSQLALKQSLEASLAETEGRYCVQLSQIQAQISALEEQLQQIRAETECQNTEYQQLLDIKIRLENEIQTYRSLLEGEGSSGGGGRGGGSFGGGYGGGSSGGGSSGGGYPHLAIILLLLFWDIHSYEDVVIDEKKSVETMIEAEVPRKRR

SEQ ID NO: 848664 - protein, 1748 aa, Homo sapiens
PRPLLPMAVAELYTQYNRVWIPDPEEVWKSAEIAKDYRVGDKVLRLLLEDGTELDYSVNPESLPPLRNPDILVGENDLTALSYLHEPAVLHNLRIRFAESKLIYTYSGIILVAMNPYKQLPIYGDAIIHAYSGQNMGDMDPHIFAVAEEAYKQMARNNRNQSIIVSGESGAGKTVSARYAMRYFATVSKSGSNAHVEDKVLASNPITEAVGNAKTTRNDNSSRFGKYTEISFDEQNQIIGANMSTYLLEKSRVVFQSENERNYHIFYQLCASAQQSEFKHLKLGSAEEFNYTRMGGNTVIEGVNDRAEMVETQKTFTLLGFKEDFQMDVFKILAAILHLGNVQITAVGNERSSVSEDDSHLKVFCELLGLESGRVAQWLCNRKIVTSSETVVKPMTRPQAVNARDALAKKIYAHLFDFIVERINQALQFSGKQHTFIGVLDIYGFETFDVNSFEQFCINYANEKLQQQFNMHVFKLEQEEYMKEDIPWTLIDFYDNQPVIDLIEAKMGILELLDEECLLPHGTDENWLQKLYNNFVNRNPLFEKPRMSNTSFVIQHFADKVEYKCEGFLEKNRDTVYDMLVEILRASKFHLCANFFQENPTPPSPFGSMITVKSAKQVIKPNSKHFRTTVGSKFRSSLYLLMETLNATTPHYVRCIKPNDEKLPFEFDSKRIVQQLRACGVLETIRISAQSYPSRWTYIEFYSRYGILMTKQELSFSDKKEVCKVVLHRLIQDSNQYQFGKTKIFFRAGQVAYLEKLRLDKLRQSCVMVQKHMRGWLQRKKFLRERRAALIIQQYFRGQQTVRKAITAVALKEAWAAIIIQKHCRGYLVRSLYQLIRMATITMQAYSRGFLARRRYRKMLEEHKAVILQKYARAWLARRRFQSIRRFVLNIQLTYRVQRLQKKLEDQNKENHGLVEKLTSLAALRAGDVEKIQKLEAELEKAATHRRNYEEKGKRYRDAVEEKLAKLQKHNSELETQKEQIQLKLQEKTEELKEKMDNLTKQLFDDVQKEERQRMLLEKSFELKTQDYEKQIQSLKEEIKALKDEKMQLQHLVEGEHVTSDGLKAEVARLSKQVKTISEFEKEIELLQAQKIDVEKHVQSQKREMREKMSEITKQLLESYDIEDVRSRLSVEDLEHLNEDGELWFAYEGLKKATRVLESHFQSQKDCYEKEIEALNFKVVHLSQEINHLQKLFREENDINESIRHEVTRLTSENMMIPDFKQQISELEKQKQDLEIRLNEQAEKMKGKLEELSNQLHRSQEEEGTQRKALEAQNEIHTKEKEKLIDKIQEMQEASDHLKKQFETESEVKCNFRQEASRLTLENRDLEEELDMKDRVIKKLQDQVKTLSKTIGKANDVHSSSGPKEYLGMLQYKREDEAKLIQNLILDLKPRGVVVNMIPGLPAHILFMCVRYADSLNDANMLKSLMNSTINGIKQVVKEHLEDFEMLSFWLSNTCHFLNCLKQYSGEEEFMKHNSPQQNKNCLNNFDLSEYRQILSDVAIRIYHQFIIIMEKNIQPIIVPGMLEYESLQGISGLKPTGFRKRSSSIDDTDGYTMTSVLQQLSYFYTTMCQNGLDPELVRQAVKQLFFLIGAVTLNSLFLRKDMCSCRKGMQIRCNISYLEEWLKDKNLQNSLAKETLEPLSQAAWLLQVKKTTDSDAKEIYERCTSLSAVQIIKILNSYTPIDDFEKRVTPSFVRKVQALLNSREDSSQLMLDTKYLFQVTFPFTPSPHALEMIQIPSSFKLGFLNRL

SEQ ID NO: 848665 - protein, 1794 aa, Homo sapiens
PRPLLPMAVAELYTQYNRVWIPDPEEVWKSAEIAKDYRVGDKVLRLLLEDGTELDYSVNPESLPPLRNPDILVGENDLTALSYLHEPAVLHNLRIRFAESKLIYTYSGIILVAMNPYKQLPIYGDAIIHAYSGQNMGDMDPHIFAVAEEAYKQMARNNRNQSIIVSGESGAGKTVSARYAMRYFATVSKSGSNAHVEDKVLASNPITEAVGNAKTTRNDNSSRFGKYTEISFDEQNQIIGANMSTYLLEKSRVVFQSENERNYHIFYQLCASAQQSEFKHLKLGSAEEFNYTRMGGNTVIEGVNDRAEMVETQKTFTLLGFKEDFQMDVFKILAAILHLGNVQITAVGNERSSVSEDDSHLKVFCELLGLESGRVAQWLCNRKIVTSSETVVKPMTRPQAVNARDALAKKIYAHLFDFIVERINQALQFSGKQHTFIGVLDIYGFETFDVNSFEQFCINYANEKLQQQFNMHVFKLEQEEYMKEDIPWTLIDFYDNQPVIDLIEAKMGILELLDEECLLPHGTDENWLQKLYNNFVNRNPLFEKPRMSNTSFVIQHFADKVEYKCEGFLEKNRDTVYDMLVEILRASKFHLCANFFQENPTPPSPFGSMITVKSAKQVIKPNSKHFRTTVGSKFRSSLYLLMETLNATTPHYVRCIKPNDEKLPFEFDSKRIVQQLRACGVLETIRISAQSYPSRWTYIEFYSRYGILMTKQELSFSDKKEVCKVVLHRLIQDSNQYQFGKTKIFFRAGQVAYLEKLRLDKLRQSCVMVQKHMRGWLQRKKFLRERRAALIIQQYFRGQQTVRKAITAVALKEAWAAIIIQKHCRGYLVRSLYQLIRMATITMQAYSRGFLARRRYRKMLEEHKAVILQKYARAWLARRRFQSIRRFVLNIQLTYRVQRLQKKLEDQNKENHGLVEKLTSLAALRAGDVEKIQKLEAELEKAATHRRNYEEKGKRYRDAVEEKLAKLQKHNSELETQKEQIQLKLQEKTEELKEKMDNLTKQLFDDVQKEERQRMLLEKSFELKTQDYEKQIQSLKEEIKALKDEKMQLQHLVEGEHVTSDGLKAEVARLSKQVKTISEFEKEIELLQAQKIDVEKHVQSQKREMREKMSEITKQLLESYDIEDVRSRLSVEDLEHLNEDGELWFAYEGLKKATRVLESHFQSQKDCYEKEIEALNFKVVHLSQEINHLQKLFREENDINESIRHEVTRLTSENMMKSHSVAQAGVQWHDLSSLQPPPPRFKQFSCLSLPSSWDYRRPPSQMIPDFKQQISELEKQKQDLEIRLNEQAEKMKGKLEELSNQLHRSQEEEGTQRKALEAQNEIHTKEKEKLIDKIQEMQEASDHLKKQFETESEVKCNFRQEASRLTLENRDLEEELDMKDRVIKKLQDQVKTLSKTIGKANDVHSSSGPKEYLGMLQYKREDEAKLIQNLILDLKPRGVVVNMIPGLPAHILFMCVRYADSLNDANMLKSLMNSTINGIKQVVKEHLEDFEMLSFWLSNTCHFLNCLKQYSGEEEFMKHNSPQQNKNCLNNFDLSEYRQILSDVAIRIYHQFIIIMEKNIQPIIVPGMLEYESLQGISGLKPTGFRKRSSSIDDTDGYTMTSVLQQLSYFYTTMCQNGLDPELVRQAVKQLFFLIGAVTLNSLFLRKDMCSCRKGMQIRCNISYLEEWLKDKNLQNSLAKETLEPLSQAAWLLQVKKTTDSDAKEIYERCTSLSAVQIIKILNSYTPIDDFEKRVTPSFVRKVQALLNSREDSSQLMLDTKYLFQVTFPFTPSPHALEMIQIPSSFKLGFLNRL

SEQ ID NO: 848666 - protein, 1613 aa, Homo sapiens
PRPLLPMAVAELYTQYNRVWIPDPEEVWKSAEIAKDYRVGDKVLRLLLEDGTELDYSVNPESLPPLRNPDILVGENDLTALSYLHEPAVLHNLRIRFAESKLIYTYSGIILVAMNPYKQLPIYGDAIIHAYSGQNMGDMDPHIFAVAEEAYKQMARNNRNQSIIVSGESGAGKTVSARYAMRYFATVSKSGSNAHVEDKVLASNPITEAVGNAKTTRNDNSSRFGKYTEISFDEQNQIIGANMSTYLLEKSRVVFQSENERNYHIFYQLCASAQQSEFKHLKLGSAEEFNYTRMGGNTVIEGVNDRAEMVETQKTFTLLGFKEDFQMDVFKILAAILHLGNVQITAVGNERSSVSEDDSHLKVFCELLGLESGRVAQWLCNRKIVTSSETVVKPMTRPQAVNARDALAKKIYAHLFDFIVERINQALQFSGKQHTFIGVLDIYGFETFDVNSFEQFCINYANEKLQQQFNMHVFKLEQEEYMKEDIPWTLIDFYDNQPVIDLIEAKMGILELLDEECLLPHGTDENWLQKLYNNFVNRNPLFEKPRMSNTSFVIQHFADKVEYKCEGFLEKNRDTVYDMLVEILRASKFHLCANFFQENPTPPSPFGSMITVKSAKQVIKPNSKHFRTTVGSKFRSSLYLLMETLNATTPHYVRCIKPNDEKLPFEFDSKRIVQQLRACGVLETIRISAQSYPSRWTYIEFYSRYGILMTKQELSFSDKKEVCKVVLHRLIQDSNQYQFGKTKIFFRAGQVAYLEKLRLDKLRQSCVMVQKHMRGWLQRKKFLRERRAALIIQQYFRGQQTVRKAITAVALKEAWAAIIIQKHCRGYLVRSLYQLIRMATITMQAYSRGFLARRRYRKMLEEHKAVILQKYARAWLARRRFQSIRRFVLNIQLTYRVQRLQKKLEDQNKENHGLVEKLTSLAALRAGDVEKIQKLEAELEKAATHRRNYEEKGKRYRDAVEEKLAKLQKHNSELETQKEQIQLKLQEKTEELKEKMDNLTKQLFDDVQKEERQRMLLEKSFELKTQDYEKQIQSLKEEIKALKDEKMQLQHLVEGEHVTSDGLKAEVARLSKQVKTISEFEKEIELLQAQKIDVEKHVQSQKREMREKMSEITKQLLESYDIEDVRSRLSVEDLEHLNEDGELWFAYEGLKKATRVLESHFQSQKDCYEKEIEALNFKVVHLSQEINHLQKLFREENDINESIRHEVTRLTSENMMIPDFKQQISELEKQKQDLEIRLNEQAEKMKGKLEELSNQLHRSQEEEGTQRKALEAQNEIHTKEKEKLIDKIQEMQEASDHLKKQFETESEVKCNFRQEASRLTLENRDLEEELDMKDRVIKKLQDQVKTLSKTIGKANDVHSSSGPKEYLGMLQYKREDEAKLIQNLILDLKPRGVVVNMIPGLPAHILFMCVRYADSLNDANMLKSLMNSTINGIKQVVKEHLEDFEMLSFWLSNTCHFLNCLKQYSGEEEFMKHNSPQQNKNCLNNFDLSEYRQILSDVAIRIYHQFIIIMEKNIQPIIVPGMLEYESLQGISGLKPTGFRKRSSSIDDTDGYTMTSVLQQLSYFYTTMCQNGLDPELVRQAVKQLFFLIGAVTLNSLFLRKDMCSCRKGMQIR

SEQ ID NO: 848667 - protein, 864 aa, Homo sapiens
PRPLLPMAVAELYTQYNRVWIPDPEEVWKSAEIAKDYRVGDKVLRLLLEDGTELDYSVNPESLPPLRNPDILVGENDLTALSYLHEPAVLHNLRIRFAESKLIYTYSGIILVAMNPYKQLPIYGDAIIHAYSGQNMGDMDPHIFAVAEEAYKQMARNNRNQSIIVSGESGAGKTVSARYAMRYFATVSKSGSNAHVEDKVLASNPITEAVGNAKTTRNDNSSRFGKYTEISFDEQNQIIGANMSTYLLEKSRVVFQSENERNYHIFYQLCASAQQSEFKHLKLGSAEEFNYTRMGGNTVIEGVNDRAEMVETQKTFTLLGFKEDFQMDVFKILAAILHLGNVQITAVGNERSSVSEDDSHLKVFCELLGLESGRVAQWLCNRKIVTSSETVVKPMTRPQAVNARDALAKKIYAHLFDFIVERINQALQFSGKQHTFIGVLDIYGFETFDVNSFEQFCINYANEKLQQQFNMHVFKLEQEEYMKEDIPWTLIDFYDNQPVIDLIEAKMGILELLDEECLLPHGTDENWLQKLYNNFVNRNPLFEKPRMSNTSFVIQHFADKVEYKCEGFLEKNRDTVYDMLVEILRASKFHLCANFFQENPTPPSPFGSMITVKSAKQVIKPNSKHFRTTVGSKFRSSLYLLMETLNATTPHYVRCIKPNDEKLPFEFDSKRIVQQLRACGVLETIRISAQSYPSRWTYIEFYSRYGILMTKQELSFSDKKEVCKVVLHRLIQDSNQYQFGKTKIFFRAGQVAYLEKLRLDKLRQSCVMVQKHMRGWLQRKKFLRERRAALIIQQYFRGQQTVRKAITAVALKEAWAAIIIQKHCRGYLVRSLYQLIRMATITMQAYSRGFLARRRYRKVRPTSV

SEQ ID NO: 848668 - protein, 1320 aa, Homo sapiens
MSCFRLYFNLFKLYFSFETFDVNSFEQFCINYANEKLQQQFNMHVFKLEQEEYMKEDIPWTLIDFYDNQPVIDLIEAKMGILELLDEECLLPHGTDENWLQKLYNNFVNRNPLFEKPRMSNTSFVIQHFADKVEYKCEGFLEKNRDTVYDMLVEILRASKFHLCANFFQENPTPPSPFGSMITVKSAKQVIKPNSKHFRTTVGSKFRSSLYLLMETLNATTPHYVRCIKPNDEKLPFEFDSKRIVQQLRACGVLETIRISAQSYPSRWTYIEFYSRYGILMTKQELSFSDKKEVCKVVLHRLIQDSNQYQFGKTKIFFRAGQVAYLEKLRLDKLRQSCVMVQKHMRGWLQRKKFLRERRAALIIQQYFRGQQTVRKAITAVALKEAWAAIIIQKHCRGYLVRSLYQLIRMATITMQAYSRGFLARRRYRKMLEEHKAVILQKYARAWLARRRFQSIRRFVLNIQLTYRVQRLQKKLEDQNKENHGLVEKLTSLAALRAGDVEKIQKLEAELEKAATHRRNYEEKGKRYRDAVEEKLAKLQKHNSELETQKEQIQLKLQEKTEELKEKMDNLTKQLFDDVQKEERQRMLLEKSFELKTQDYEKQIQSLKEEIKALKDEKMQLQHLVEGEHVTSDGLKAEVARLSKQVKTISEFEKEIELLQAQKIDVEKHVQSQKREMREKMSEITKQLLESYDIEDVRSRLSVEDLEHLNEDGELWFAYEGLKKATRVLESHFQSQKDCYEKEIEALNFKVVHLSQEINHLQKLFREENDINESIRHEVTRLTSENMMIPDFKQQISELEKQKQDLEIRLNEQAEKMKGKLEELSNQLHRSQEEEGTQRKALEAQNEIHTKEKEKLIDKIQEMQEASDHLKKQFETESEVKCNFRQEASRLTLENRDLEEELDMKDRVIKKLQDQVKTLSKTIGKANDVHSSSGPKEYLGMLQYKREDEAKLIQNLILDLKPRGVVVNMIPGLPAHILFMCVRYADSLNDANMLKSLMNSTINGIKQVVKEHLEDFEMLSFWLSNTCHFLNCLKQYSGEEEFMKHNSPQQNKNCLNNFDLSEYRQILSDVAIRIYHQFIIIMEKNIQPIIVPGMLEYESLQGISGLKPTGFRKRSSSIDDTDGYTMTSVLQQLSYFYTTMCQNGLDPELVRQAVKQLFFLIGAVTLNSLFLRKDMCSCRKGMQIRCNISYLEEWLKDKNLQNSLAKETLEPLSQAAWLLQVKKTTDSDAKEIYERCTSLSAVQIIKILNSYTPIDDFEKRVTPSFVRKVQALLNSREDSSQLMLDTKYLFQVTFPFTPSPHALEMIQIPSSFKLGFLNRL

SEQ ID NO: 848669 - protein, 577 aa, Homo sapiens
MWLEAQYPDLGQSDVAQLQKLFREENDINESIRHEVTRLTSENMMIPDFKQQISELEKQKQDLEIRLNEQAEKMKGKLEELSNQLHRSQEEEGTQRKALEAQNEIHTKEKEKLIDKIQEMQEASDHLKKQFETESEVKCNFRQEASRLTLENRDLEEELDMKDRVIKKLQDQVKTLSKTIGKANDVHSSSGPKEYLGMLQYKREDEAKLIQNLILDLKPRGVVVNMIPGLPAHILFMCVRYADSLNDANMLKSLMNSTINGIKQVVKEHLEDFEMLSFWLSNTCHFLNCLKQYSGEEEFMKHNSPQQNKNCLNNFDLSEYRQILSDVAIRIYHQFIIIMEKNIQPIIVPGMLEYESLQGISGLKPTGFRKRSSSIDDTDGYTMTSVLQQLSYFYTTMCQNGLDPELVRQAVKQLFFLIGAVTLNSLFLRKDMCSCRKGMQIRCNISYLEEWLKDKNLQNSLAKETLEPLSQAAWLLQVKKTTDSDAKEIYERCTSLSAVQIIKILNSYTPIDDFEKRVTPSFVRKVQALLNSREDSSQLMLDTKYLFQVTFPFTPSPHALEMIQIPSSFKLGFLNRL

SEQ ID NO: 848670 - protein, 969 aa, Homo sapiens
MAEDDPYLGRPEQMFHLDPSLTHTIFNPEVFQPQMALPTADGPYLQILEQPKQRGFRFRYVCEGPSHGGLPGASSEKNKKSYPQVKICNYVGPAKVIVQLVTNGKNIHLHAHSLVGKHCEDGICTVTAGPKDMVVGFANLGILHVTKKKVFETLEARMTEACIRGYNPGLLVHPDLAYLQAEGGGDRQLGDREKELIRQAALQQTKEMDLSVVRLMFTAFLPDSTGSFTRRLEPVVSDAIYDSKAPNASNLKIVRMDRTAGCVTGGEEIYLLCDKVQKDDIQIRFYEEEENGGVWEGFGDFSPTDVHRQFAIVFKTPKYKDINITKPASVFVQLRRKSDLETSEPKPFLYYPEIKDKEEVQRKRQKLMPNFSDSFGGGSGAGAGGGGMFGSGGGGGGTGSTGPGYSFPHYGFPTYGGITFHPGTTKSNAGMKHGTMDTESKKDPEGCDKSDDKNTVNLFGKVIETTEQDQEPSEATVGNGEVTLTYATGTKEESAGVQDNLFLEKAMQLAKRHANALFDYAVTGDVKMLLAVQRHLTAVQDENGDSVLHLAIIHLHSQLVRDLLEVTSGLISDDIINMRNDLYQTPLHLAVITKQEDVVEDLLRAGADLSLLDRLGNSVLHLAAKEGHDKVLSILLKHKKAALLLDHPNGDGLNAIHLAMMSNSLPCLLLLVAAGADVNAQEQKSGRTALHLAVEHDNISLAGCLLLEGDAHVDSTTYDGTTPLHIAAGRGSTRLAALLKAAGADPLVENFEPLYDLDDSWENAGEDEGVVPGTTPLDMATSWQVFDILNGKPYEPEFTSDDLLAQGDMKQLAEDVKLQLYKLLEIPDPDKNWATLAQKLGLGILNNAFRLSPAPSKTLMDNYEVSGGTVRELVEALRQMGYTEAIEVIQAASSPVKTTSQAHSLPLSPASTRQQIDELRDSDSVCDSGVETSFRKLSFTESLTSGASLLTLNKMPHDYGQEGPLEGKI

SEQ ID NO: 848671 - protein, 969 aa, Homo sapiens; identical to SEQ ID NO: 848670

SEQ ID NO: 848672 - protein, 762 aa, Homo sapiens
MDLSVVRLMFTAFLPDSTGSFTRRLEPVVSDAIYDSKAPNASNLKIVRMDRTAGCVTGGEEIYLLCDKVQKDDIQIRFYEEEENGGVWEGFGDFSPTDVHRQFAIVFKTPKYKDINITKPASVFVQLRRKSDLETSEPKPFLYYPEIKDKEEVQRKRQKLMPNFSDSFGGGSGAGAGGGGMFGSGGGGGGTGSTGPGYSFPHYGFPTYGGITFHPGTTKSNAGMKHGTMDTESKKDPEGCDKSDDKNTVNLFGKVIETTEQDQEPSEATVGNGEVTLTYATGTKEESAGVQDNLFLEKAMQLAKRHANALFDYAVTGDVKMLLAVQRHLTAVQDENGDSVLHLAIIHLHSQLVRDLLEVTSGLISDDIINMRNDLYQTPLHLAVITKQEDVVEDLLRAGADLSLLDRLGNSVLHLAAKEGHDKVLSILLKHKKAALLLDHPNGDGLNAIHLAMMSNSLPCLLLLVAAGADVNAQEQKSGRTALHLAVEHDNISLAGCLLLEGDAHVDSTTYDGTTPLHIAAGRGSTRLAALLKAAGADPLVENFEPLYDLDDSWENAGEDEGVVPGTTPLDMATSWQVFDILNGKPYEPEFTSDDLLAQGDMKQLAEDVKLQLYKLLEIPDPDKNWATLAQKLGLGILNNAFRLSPAPSKTLMDNYEVSGGTVRELVEALRQMGYTEAIEVIQAASSPVKTTSQAHSLPLSPASTRQQIDELRDSDSVCDSGVETSFRKLSFTESLTSGASLLTLNKMPHDYGQEGPLEGKI

SEQ ID NO: 848673 - protein, 788 aa, Homo sapiens
MNGLCCMALDREKELIRQAALQQTKEMDLSVVRLMFTAFLPDSTGSFTRRLEPVVSDAIYDSKAPNASNLKIVRMDRTAGCVTGGEEIYLLCDKVQKDDIQIRFYEEEENGGVWEGFGDFSPTDVHRQFAIVFKTPKYKDINITKPASVFVQLRRKSDLETSEPKPFLYYPEIKDKEEVQRKRQKLMPNFSDSFGGGSGAGAGGGGMFGSGGGGGGTGSTGPGYSFPHYGFPTYGGITFHPGTTKSNAGMKHGTMDTESKKDPEGCDKSDDKNTVNLFGKVIETTEQDQEPSEATVGNGEVTLTYATGTKEESAGVQDNLFLEKAMQLAKRHANALFDYAVTGDVKMLLAVQRHLTAVQDENGDSVLHLAIIHLHSQLVRDLLEVTSGLISDDIINMRNDLYQTPLHLAVITKQEDVVEDLLRAGADLSLLDRLGNSVLHLAAKEGHDKVLSILLKHKKAALLLDHPNGDGLNAIHLAMMSNSLPCLLLLVAAGADVNAQEQKSGRTALHLAVEHDNISLAGCLLLEGDAHVDSTTYDGTTPLHIAAGRGSTRLAALLKAAGADPLVENFEPLYDLDDSWENAGEDEGVVPGTTPLDMATSWQVFDILNGKPYEPEFTSDDLLAQGDMKQLAEDVKLQLYKLLEIPDPDKNWATLAQKLGLGILNNAFRLSPAPSKTLMDNYEVSGGTVRELVEALRQMGYTEAIEVIQAASSPVKTTSQAHSLPLSPASTRQQIDELRDSDSVCDSGVETSFRKLSFTESLTSGASLLTLNKMPHDYGQEGPLEGKI

SEQ ID NO: 848674 - protein, 969 aa, Homo sapiens; identical to SEQ ID NO: 848670

SEQ ID NO: 848675 - protein, 332 aa, Homo sapiens
MAEDDPYLGRPEQMFHLDPSLTHTIFNPEVFQPQMALPTADGPYLQILEQPKQRGFRFRYVCEGPSHGGLPGASSEKNKKSYPQVKICNYVGPAKVIVQLVTNGKNIHLHAHSLVGKHCEDGICTVTAGPKDMVVGFANLGILHVTKKKVFETLEARMTEACIRGYNPGLLVHPDLAYLQAEGGGDRQLGDREKELIRQAALQQTKEMDLSVVRLMFTAFLPDSTGSFTRRLEPVVSDAIYDSKAPNASNLKIVRMDRTAGCVTGGEEIYLLCDKVQKDDIQIRFYEEEENGGVWEGFGDFSPTDVHRQALPLFWNFLSHLVERAQKQPWAL

SEQ ID NO: 848676 - protein, 114 aa, Homo sapiens
GHRSGPATIADSFPCPSRRSGRQPPQPSACTQPPAPLPEPSAAEAAAARPVRRRRRPATAGPAASLRPRCGHGAALTGLARPRRAPARPDPHSGPPGLRPAAASSFSSRQARAA

SEQ ID NO: 848677 - protein, 969 aa, Homo sapiens; identical to SEQ ID NO: 848670

SEQ ID NO: 848678 - protein, 969 aa, Homo sapiens; identical to SEQ ID NO: 848670

SEQ ID NO: 848679 - protein, 384 aa, Homo sapiens
FRECLFMFMSPENIIGDCGSSKQNNRLIVSLLSLPMIQFLPFPSASQGPSCELAIPSCDCPFAWTLGLNAIHLAMMSNSLPCLLLLVAAGADVNAQEQKSGRTALHLAVEHDNISLAGCLLLEGDAHVDSTTYDGTTPLHIAAGRGSTRLAALLKAAGADPLVENFEPLYDLDDSWENAGEDEGVVPGTTPLDMATSWQVFDILNGKPYEPEFTSDDLLAQGDMKQLAEDVKLQLYKLLEIPDPDKNWATLAQKLGLGILNNAFRLSPAPSKTLMDNYEVSGGTVRELVEALRQMGYTEAIEVIQAASSPVKTTSQAHSLPLSPASTRQQIDELRDSDSVCDSGVETSFRKLSFTESLTSGASLLTLNKMPHDYGQEGPLEGKI

SEQ ID NO: 848680 - protein, 969 aa, Homo sapiens
MAEDDPYLGRPEQMFHLDPSLTHTIFNPEVFQPQMALPTADGPYLQILEQPKQRGFRFRYVCEGPSHGGLPGASSEKNKKSYPQVKICNYVGPAKVIVQLVTNGKNIHLHAHSLVGKHCEDGICTVTAGPKDMVVGFANLGILHVTKKKVFETLEARMTEACIRGYNPGLLVHPDLAYLQAEGGGDRQLGDREKELIRQAALQQTKEMDLSVVRLMFTAFLPDSTGSFTRRLEPVVSDAIYDSKAPNASNLKIVRMDRTAGCVTGGEEIYLLCDKVQKDDIQIRFYEEEENGGVWEGFGDFSPTDVHRQFAIVFKTPKYKDINITKPASVFVQLRRKSDLETSEPKPFLYYPEIKDKEEVQRKRQKLMPNFSDSFGGGSGAGAGGGGMFGSGGGGGGTGSTGPGYSFPHYGFPTYGGITFHPGTTKSNAGMKHGTMDTESKKDPEGCDKSDDKNTVNLFGKVIETTEQDQEPSEATVGNGEVTLTYATGTKEESAGVQDNLFLEKAMQLAKRHANALFDYAVTGDVKMLLAVQRHLTAVQDENGDSVLHLAIIHLHSQLVRDLLEVTSGLISDDIINMRNDLYQTPLHLAVITKQEDVVEDLLRAGADLSLLDRLGNSVLHLAAKEGHDKVLSILLKHKKAALLLDHPNGDGLNAIHLAMMSNSLPCLLLLVAAGADVNAQEQKSGRTALHLAVEHDNISLAGCLLLEGDAHVDSTTYDGTTPLHIAAGRGSTRLAALLKAAGADPLVENFEPLYDLDDSWENAGEDEGVVPGTTPLDMATSWQVFDILNGKPYEPEFTSDDLLAQGDMKQLAEDVKLQLYKLLEIPDPDKNWATLAQKLGLGILNNAFRLSPAPSKTLMDNYEVSGGTVRELVEALRQMGYTEAIEVIQAASSPVKTTSQAHSLPLSPASTRQQIGKKKDKRQWRYFPAPPGWCLQLFLDMVWQFSFSFSGYTSLCVSLPPGLTLCLS

SEQ ID NO: 848681 - protein, 99 aa, Homo sapiens
FLPFPSASQGPSCELAIPSCDCPFAWTLGLNAIHLAMMSNSLPCLLLLVAAGADVNAQEQKSGRTALHLAVEHDNISLAGCLLLEVKGTLICFCIKFLR

SEQ ID NO: 848682 - protein, 137 aa, Homo sapiens
MEEETPLFLPLCLSFGPGDSPSSVRNRSLTEMMATGTPESQARFGQSVKGLLTEKVTTCGTDVIALTKQVLKGSRSSELLGQAARNMVLQEDAILHSEDSLRKMAIITTHLQYQQEAIQKNVEQSSDLQDQLNHLLK

SEQ ID NO: 848683 - protein, 137 aa, Homo sapiens; identical to SEQ ID NO: 848682

SEQ ID NO: 848684 - protein, 137 aa, Homo sapiens; identical to SEQ ID NO: 848682

SEQ ID NO: 848685 - protein, 137 aa, Homo sapiens; identical to SEQ ID NO: 848682

SEQ ID NO: 848686 - protein, 359 aa, Homo sapiens
MTLAALRDAEIQKDVQTYYGQVLKRSADLQTNGCVTTARPVPKHIREALQNVHEEVALRYYGCGLVIPEHLENCWILDLGSGSGRDCYVLSQLVGEKGHVTGIDMTKGQVEVAEKYLDYHMEKYGFQASNVTFIHGYIEKLGEAGIKNESHDIVVSNCVINLVPDKQQVLQEAYRVLKHGGELYFSDVYTSLELPEEIRTHKVLWGECLGGALYWKELAVLAQKIGFCPPRLVTANLITIQNKELERVIGDCRFVSATFRLFKHSKTGPTKRCQVIYNGGITGHEMDEETAAILKNSRFAQDFLIRPIGEKLPTSGGCSALELKDIITDPFKLAEESDSMKSRCVPDAAGGCCGTKKSC

SEQ ID NO: 848687 - protein, 86 aa, Homo sapiens
ALSLEDFEWCCRVDEETAAILKNSRFAQDFLIRPIGEKLPTSGGCSALELKDIITDPFKLAEESDSMKSRCVPDAAGGCCGTKKSC

SEQ ID NO: 848688 - protein, 382 aa, Homo sapiens
MAALRDAEIQKDVQTYYGQVLKRSADLQTNGCVTTARPVPKHIREALQNVHEEVALRYYGCGLVIPEHLENCWILDLGSGSGRDCYVLSQLVGEKGHVTGIDMTKGQVEVAEKYLDYHMEKYGFQASNVTFIHGYIEKLGEAGIKNESHDIVVSNCVINLVPDKQQVLQEAYRVLKHGGELYFSDVYTSLELPEEIRTHKVLWGECLGGALYWKELAVLAQKIGFCPPRLVTANLITIQNKELERVIGDCRFVSATFRLFKHSKTGPTKRCQVIYNGGITGHEKELMFDANFTFKEGEIVEVDEETAAILKNSRFAQDFLIRPIGEKLPTSGGCSALELKDIITDPFKLAEESDSMKSRCVPDAAGGCCGTKSACFLTCFSP

SEQ ID NO: 848689 - protein, 375 aa, Homo sapiens
MAALRDAEIQKDVQTYYGQVLKRSADLQTNGCVTTARPVPKHIREALQNVHEEVALRYYGCGLVIPEHLENCWILDLGSGSGRDCYVLSQLVGEKGHVTGIDMTKGQVEVAEKYLDYHMEKYGFQASNVTFIHGYIEKLGEAGIKNESHDIVVSNCVINLVPDKQQVLQEAYRVLKHGGELYFSDVYTSLELPEEIRTHKVLWGECLGGALYWKELAVLAQKIGFCPPRLVTANLITIQNKELERVIGDCRFVSATFRLFKHSKTGPTKRCQVIYNGGITGHEKELMFDANFTFKEGEIVEVDEETAAILKNSRFAQDFLIRPIGEKLPTSGGCSALELKDIITDPFKLAEESDSMKSRCVPDAAGGCCGTKKSC

SEQ ID NO: 848690 - protein, 137 aa, Homo sapiens; identical to SEQ ID NO: 848682

SEQ ID NO: 848691 - protein, 137 aa, Homo sapiens; identical to SEQ ID NO: 848682

SEQ ID NO: 848692 - protein, 375 aa, Homo sapiens; identical to SEQ ID NO: 848689

SEQ ID NO: 848693 - protein, 255 aa, Homo sapiens
MTKGQVEVAEKYLDYHMEKYGFQASNVTFIHGYIEKLGEAGIKNESHDIVVSNCVINLVPDKQQVLQEAYRVLKHGGELYFSDVYTSLELPEEIRTHKVLWGECLGGALYWKELAVLAQKIGFCPPRLVTANLITIQNKELERVIGDCRFVSATFRLFKHSKTGPTKRCQVIYNGGITGHEMDEETAAILKNSRFAQDFLIRPIGEKLPTSGGCSALELKDIITDPFKLAEESDSMKSRCVPDAAGGCCGTKKSC

SEQ ID NO: 848694 - protein, 110 aa, Homo sapiens
MGGRSKPASLGGASAQELAAGARRPESQAEETVSARPESQAEETVSARPESQAEETVSARPGRPAPAPSPFPGPPQGGNASASPELCLETFVLPSPLGPLPALYWPPPSC

SEQ ID NO: 848695 - protein, 296 aa, Homo sapiens
MDTPLRRSRRLGGLRPESPESLTSVSRTRRALVEFESNPEETREPGSPPSVQRAGLGSPERPPKTSPGSPRLQQGAGLESPQGQPEPGAASPQRQQDLHLESPQRQPEYSPESPRCQPKPSEEAPKCSQDQGVLASELAQNKEELTPGAPQHQLPPVPGSPEPYPGQQAPGPEPSQPLLELTPRAPGSPRGQHEPSKPPPAGETVTGGFGAKKRKGSSSQAPASKKLNKEELPVIPKGKPKSGRVWKDRSKKRFSRCFRKALAHRGREMRRRRGAGRIERLEKNEAGRNKFGGIRS

SEQ ID NO: 848696 - protein, 360 aa, Homo sapiens
MDTPLRRSRRLGGLRPESPESLTSVSRTRRALVEFESNPEETREPGSPPSVQRAGLGSPERPPKTSPGSPRLQQGAGLESPQGQPEPGAASPQRQQDLHLESPQRQPEYSPESPRCQPKPSEEAPKCSQDQGVLASELAQNKEELTPGAPQHQLPPVPGSPEPYPGQQAPGPEPSQPLLELTPRAPGSPRGQHEPSKPPPAGETVTGGFGAKKRKGSSSQAPASKKLNKEELPVIPKGKPKSGRVWKDRSKKRFSQMLQDKPLRTSWQRKMKERQERKLAKDFARHLEEEKERRRQEKKQRRAENLKRRLENERKAEVVQVIRNPAKLKRAKKKQLRSIEKRDTLALLQKQPPQQPAAKI

SEQ ID NO: 848697 - protein, 421 aa, Homo sapiens
MDTPLRRSRRLGGLRPESPESLTSVSRTRRALVEFESNPEETREPGSPPSVQRAGLGSPERPPKTSPGSPRLQQGAGLESPQGQPEPGAASPQRQQDLHLESPQRQPEYSPESPRCQPKPSEEAPKCSQDQGVLASELAQNKEELTPGAPQHQLPPVPGSPEPYPGQQAPGPEPSQPLLELTPRAPGSPRGQHEPSKPPPAGETVTGGFGAKKRKGSSSQAPASKKLNKEELPVIPKGKPKSGRVWKDRSKKRFSQMLQDKPLRTSWQRKMKERQERKLATNMSDTATQGAQVIRNPANSSGEARARGLQLTKRETLGLVVKERPEGGSQNRHGEAEGSSLANKNALVGSRTTTWVQQGATSTGPQLKGKQDIRNHRRVARSERNDEHIARQIATEELSEQTTQHIQQHTVPRGHNGEKKQ

SEQ ID NO: 848698 - protein, 360 aa, Homo sapiens; identical to SEQ ID NO: 848696

SEQ ID NO: 848699 - protein, 360 aa, Homo sapiens; identical to SEQ ID NO: 848696

SEQ ID NO: 848700 - protein, 525 aa, Homo sapiens
MEGPAEWGPEAALGPEAVLRFLAERGGRALHAELVQHFRGALGGEPEQRARARAHFKELVNAVATVRVDPADGAKYVHLKKRFCEGPSEPSGDPPRIQVTAEPEAPDGPAGPEARDRLPDAAAPESLPGQGRELGEGEPPAPAHWPPLSAGARRKNSRRDVQPLPRTPAPGPSEDLELPPHGCEEADRGSSLVGATAQRPARQNLRDLVMGSSPQLKRSVCPGGSSPGSSSGGGRGRGGGDSDSASVASSSAEEESSGGGSVTLDPLEHAWMLSASDGKWDSLEGLLTCEPGLLVKRDFIYRLHLPALGRKHGRQELVAMLVNFANKHQLPVNMDARTSGGYTALHLAAMHGHVEVVKLLVGAYDADVDIRDYSGKKASQYLSRSIAEEIKNLVGALDEGDGESAAGSGGGRWRLSKVLPSHLITYKLSHALEDGGDHHHHHHSAEGWVGGKAKDPGRKASGSSSGRIKPRLNKIRFRTQIVHTTPSFRDPEQPLEGRGEEGVGEERPVKGHSPFTLRPKSNVFG

SEQ ID NO: 848701 - protein, 525 aa, Homo sapiens; identical to SEQ ID NO: 848700

SEQ ID NO: 848702 - protein, 525 aa, Homo sapiens; identical to SEQ ID NO: 848700

SEQ ID NO: 848703 - protein, 232 aa, Homo sapiens [sequence omitted]

SEQ ID NO: 848704 - protein, 442 aa, Homo sapiens [sequence omitted]

SEQ ID NO: 848705 - protein, 339 aa, Homo sapiens
MAGEGDQQDAAHNMGNHLPLLPAESEEEDEMEVEDQDSKEAKKPNIINFDTSLPTSHTYLGADMEEFHGRTLHDDDSCQVIPVLPQVMMILIPGQTLPLQLFHPQEVSMVRNLIQKDRTFAVLAYSNVQEREAQFGTTAEIYAYREEQDFGIEIVKVKAIGRQRFKVLELRTQSDGIQQAKVQILPECVLPSTMSAVQLESLNKCQIFPSKPVSREDQCSYKWWQKYQKRKFHCANLTSWPRWLYSLYDAETLMDRIKKQLREWDENLKDDSLPSNPIDFSYRVAACLPIDDVLRIQLLKIGSAIQRLRCELDIMNKCTSLCCKQCQETEITTKNEIFR

SEQ ID NO: 848706 - protein, 305 aa, Homo sapiens
MAGEGDQQDAAHNMGNHLPLLPAESEEEDEMEVEDQDSKEAKKPNIINFDTSLPTSHTYLGADMEEFHGRTLHDDDSCQVIPVLPQVMMILIPGQTLPLQLFHPQEVSMVRNLIQKDRTFAVLAYSNVQEREAQFGTTAEIYAYREEQDFGIEIVKVKAIGRQRFKVLELRTQSDGIQQAKVQILPECVLPSTMSAVQLESLNKCQIFPSKPVSREDQCSYKWWQKYQKRKFHCANLTSWPRWLYSLYDAETLMDRIKKQLREWDENLKDDSLPSNPIDFSYRVAACLPIDDVLRIQLLMYFPLL

SEQ ID NO: 848707 - protein, 282 aa, Homo sapiens [sequence omitted]

SEQ ID NO: 848708 - protein, 411 aa, Homo sapiens
MAGEGDQQDAAHNMGNHLPLLPAESEEEDEMEVEDQDSKEAKKPNIINFDTSLPTSHTYLGADMEEFHGRTLHDDDSCQVIPVLPQVMMILIPGQTLPLQLFHPQEVSMVRNLIQKDRTFAVLAYSNVQEREAQFGTTAEIYAYREEQDFGIEIVKVKAIGRQRFKVLELRTQSDGIQQAKVQILPECVLPSTMSAVQLESLNKCQIFPSKPVSREDQCSYKWWQKYQKRKFHCANLTSWPRWLYSLYDAETLMDRIKKQLREWDENLKDDSLPSNPIDFSYRVAACLPIDDVLRIQLLKIGSAIQRLRCELDIMNKCTSLCCKQCQETEITTKNEIFSLSLCGPMAAYVNPHGYVHETLTVYKACNLNLIGRPSTEHSWFPGYAWTVAQCKICASHIGWKFTATKKDMSH

SEQ ID NO: 848709 - protein, 339 aa, Homo sapiens; identical to SEQ ID NO: 848705

SEQ ID NO: 848710 - protein, 339 aa, Homo sapiens; identical to SEQ ID NO: 848705

SEQ ID NO: 848711 - protein, 442 aa, Homo sapiens [sequence omitted]

SEQ ID NO: 848712 - protein, 379 aa, Homo sapiens
MEEFHGRTLHDDDSCQVIPVLPQVMMILIPGQTLPLQLFHPQEVSMVRNLIQKDRTFAVLAYSNVQEREAQFGTTAEIYAYREEQDFGIEIVKVKAIGRQRFKVLELRTQSDGIQQAKVQILPECVLPSTMSAVQLESLNKCQIFPSKPVSREDQCSYKWWQKYQKRKFHCANLTSWPRWLYSLYDAETLMDRIKKQLREWDENLKDDSLPSNPIDFSYRVAACLPIDDVLRIQLLKIGSAIQRLRCELDIMNKCTSLCCKQCQETEITTKNEIFSLSLCGPMAAYVNPHGYVHETLTVYKACNLNLIGRPSTEHSWFPGYAWTVAQCKICASHIGWKFTATKKDMSPQKFWGLTRSALLPTIPDTEDEISPDKVILCL

SEQ ID NO: 848713 - protein, 200 aa, Homo sapiens [sequence omitted]

SEQ ID NO: 848714 - protein, 194 aa, Homo sapiens
MAGEGDQQDAAHNMGNHLPLLPAESEEEDEMEVEDQDSKEAKKPNIINFDTSLPTSHTYLGADMEEFHGRTLHDDDSCQVIPVLPQVMMILIPGQTLPLQLFHPQEVSMVRNLIQKDRTFAVLAYSNVQEREAQFGTTAEIYAYREEQDFGIEIVKVKAIGRQRFKVLELRTQSDGYSPVVSNLAMHQNHLGSF

SEQ ID NO: 848715 - protein, 442 aa, Homo sapiens [sequence omitted]

SEQ ID NO: 848716 - protein, 442 aa, Homo sapiens [sequence omitted]

SEQ ID NO: 848717 - protein, 282 aa, Homo sapiens [sequence omitted]

SEQ ID NO: 848718 - protein, 442 aa, Homo sapiens [sequence omitted]

SEQ ID NO: 848719 - protein, 282 aa, Homo sapiens [sequence omitted]

SEQ ID NO: 848720 - protein, 339 aa, Homo sapiens; identical to SEQ ID NO: 848705

SEQ ID NO: 848721 - protein, 414 aa, Homo sapiens
ACLAGKQTWPAKEISRTLRTTWATTCRSCLYLGADMEEFHGRTLHDDDSCQVIPVLPQVMMILIPGQTLPLQLFHPQEVSMVRNLIQKDRTFAVLAYSNVQEREAQFGTTAEIYAYREEQDFGIEIVKVKAIGRQRFKVLELRTQSDGIQQAKVQILPECVLPSTMSAVQLESLNKCQIFPSKPVSREDQCSYKWWQKYQKRKFHCANLTSWPRWLYSLYDAETLMDRIKKQLREWDENLKDDSLPSNPIDFSYRVAACLPIDDVLRIQLLKIGSAIQRLRCELDIMNKCTSLCCKQCQETEITTKNEIFSLSLCGPMAAYVNPHGYVHETLTVYKACNLNLIGRPSTEHSWFPGYAWTVAQCKICASHIGWKFTATKKDMSPQKFWGLTRSALLPTIPDTEDEISPDKVILCL

SEQ ID NO: 848722 - protein, 334 aa, Homo sapiens
MVRNLIQKDRTFAVLAYSNVQEREAQFGTTAEIYAYREEQDFGIEIVKVKAIGRQRFKVLELRTQSDGIQQAKVQILPECVLPSTMSAVQLESLNKCQIFPSKPVSREDQCSYKWWQKYQKRKFHCANLTSWPRWLYSLYDAETLMDRIKKQLREWDENLKDDSLPSNPIDFSYRVAACLPIDDVLRIQLLKIGSAIQRLRCELDIMNKCTSLCCKQCQETEITTKNEIFSLSLCGPMAAYVNPHGYVHETLTVYKACNLNLIGRPSTEHSWFPGYAWTVAQCKICASHIGWKFTATKKDMSPQKFWGLTRSALLPTIPDTEDEISPDKVILCL

SEQ ID NO: 848723 - protein, 230 aa, Homo sapiens
QLDSMTTAKCQLTIEYELRSASSYMVANRTSWHSLRDSIYTANTVKGNLLKLRSAECAGFRLAISLNFSYRVAACLPIDDVLRIQLLKIGSAIQRLRCELDIMNKCTSLCCKQCQETEITTKNEIFSLSLCGPMAAYVNPHGYVHETLTVYKACNLNLIGRPSTEHSWFPGYAWTVAQCKICASHIGWKFTATKKDMSPQKFWGLTRSALLPTIPDTEDEISPDKVILCL

SEQ ID NO: 848724 - protein, 176 aa, Homo sapiens
MAGEGDQQDAAHNMGNHLPLLPAESEEEDEMEVEDQDSKEAKKPNIINFDTSLPTSHTYLGADMEEFHGRTLHDDDSCQVIPVLPQVMMILIPGQTLPLQLFHPQEVSMVRNLIQKDRTFAVLAYSNVQEREAQFGTTAEIYAYREEQDFGIEIVKVKAIGRQRFKVLELRTQSDG

SEQ ID NO: 848725 - protein, 84 aa, Homo sapiens
AGGGTDGLVGGAENCRELLETEDRNPGSRPRGLRTVGRLAGERGKDGAWPPGLPVPCLELTPTVYCRELTRSHFEKKLERIPSG

SEQ ID NO: 848726 - protein, 160 aa, Homo sapiens
AGGGTDGLVGGAENCRELLETEDRNPGSRPRGLRTVGRLAGERGKDGAWPPGLPVPCLELTPTGESPPSSGSAQPAGFLWKSGGPTVYVRPFDRSWRSSVDPRFSLLINVGQFETGSRAYVLRKKNFIETSGGVEKTILTITVYYRSEFHSPKMLKKQAS

SEQ ID NO: 848727 - protein, 385 aa, Homo sapiens
MLWKLLLRSQSCRLCSFRKMRSPPKYRPFLACFTYTTDKQSSKENTRTVEKLYKCSVDIRKIRRLKGWVLLEDETYVEEIANILQELGADETAVASILERCPEAIVCSPTAVNTQRKLWQLVCKNEEELIKLIEQFPESFFTIKDQENQKLNVQFFQELGLKNVVISRLLTAAPNVFHNPVEKNKQMVRILQESYLDVGGSEANMKVWLLKLLSQNPFILLNSPTAIKETLEFLQEQGFTSFEILQLLSKLKGFLFQLCPRSIQNSISFSKNAFKCTDHDLKQLVLKCPALLYYSVPVLEERMQGLLREGISIAQIRETPMVLELTPQIVQYRIRKLNSSGYRIKDGHLANLNGSKKEFEANFGKIQAKKVRPLFNPVAPLNVEE

SEQ ID NO: 848728 - protein, 84 aa, Homo sapiens; identical to SEQ ID NO: 848725

SEQ ID NO: 848729 - protein, 385 aa, Homo sapiens; identical to SEQ ID NO: 848727

SEQ ID NO: 848730 - protein, 475 aa, Homo sapiens
DAWVDPRVGLCPTEKNVDLSTFYQNRAAAFEQLQKWKEVAQDCTKAVELNPKYVKALFRRAKAHEKLDNKKECLEDVTAVCILEGFQNQQSMLLADKVLKLLGKEKAKEKYKNREPLMPSPQFIKSYFSSFTDDIISQPMLKGEKSDEDKDKEGEALEVKENSGYLKAKQYMEEENYDKIISECSKEIDAEGKYMAEALLLRATFYLLIGNANAAKPDLDKVISLKEANVKLRANALIKRGSMYMQQQQPLLSTQDFNMAADIDPQNADVYHHRGQLKILLDQVEEAVADFDECIRLRPESALAQAQKCFALYRQAYTGNNSSQIQAAMKGFEEVIKKFPRCAEGYALYAQALTDQQQFGKADEMYDKCIDLEPDNATTYVHKGLLQLQWKQDLDRGLELISKAIEIDNKCDFAYETMGTIEVQRGNMEKAIDMFNKAINLAKSEMEMAHLYSLCDAAHAQTEVAKKYGLKPPTL

SEQ ID NO: 848731 - protein, 521 aa, Homo sapiens
LLWSESVNVDYVFDNCFLSFQNSLDRAQAAKNKGNKYFKAGKYEQAIQCYTEAISLCPTEKNVDLSTFYQNRAAAFEQLQKWKEVAQDCTKAVELNPKYVKALFRRAKAHEKLDNKKECLEDVTAVCILEGFQNQQSMLLADKVLKLLGKEKAKEKYKNREPLMPSPQFIKSYFSSFTDDIISQPMLKGEKSDEDKDKEGEALEVKENSGYLKAKQYMEEENYDKIISECSKEIDAEGKYMAEALLLRATFYLLIGNANAAKPDLDKVISLKEANVKLRANALIKRGSMYMQQQQPLLSTQDFNMAADIDPQNADVYHHRGQLKILLDQVEEAVADFDECIRLRPESALAQAQKCFALYRQAYTGNNSSQIQAAMKGFEEVIKKFPRCAEGYALYAQALTDQQQFGKADEMYDKCIDLEPDNATTYVHKGLLQLQWKQDLDRGLELISKAIEIDNKCDFAYETMGTIEVQRGNMEKAIDMFNKAINLAKSEMEMAHLYSLCDAAHAQTEVAKKYGLKPPTL

SEQ ID NO: 848732 - protein, 264 aa, Homo sapiens
GRLLLLNSRPRRRLKEANVKLRANALIKRGSMYMQQQQPLLSTQDFNMAADIDPQNADVYHHRGQLKILLDQVEEAVADFDECIRLRPESALAQAQKCFALYRQAYTGNNSSQIQAAMKGFEEVIKKFPRCAEGYALYAQALTDQQQFGKADEMYDKCIDLEPDNATTYVHKGLLQLQWKQDLDRGLELISKAIEIDNKCDFAYETMGTIEVQRGNMEKAIDMFNKAINLAKSEMEMAHLYSLCDAAHAQTEVAKKYGLKPPTL

SEQ ID NO: 848733 - protein, 608 aa, Homo sapiens
MAASKPVEAAVVAAAVPSSGSGVGGGGTAGPGTGGLPRWQLALAVGAPLLLGAGAIYLWSRQQRRREARGRGDASGLKRNSERKTPEGRASPAPGSGHPEGPGAHLDMNSLDRAQAAKNKGNKYFKAGKYEQAIQCYTEAISLCPTEKNVDLSTFYQNRAAAFEQLQKWKEVAQDCTKAVELNPKYVKALFRRAKAHEKLDNKKECLEDVTAVCILEGFQNQQSMLLADKVLKLLGKEKAKEKYKNREPLMPSPQFIKSYFSSFTDDIISQPMLKGEKSDEDKDKEGEALEVKENSGYLKAKQYMEEENYDKIISECSKEIDAEGKYMAEALLLRATFYLLIGNANAAKPDLDKVISLKEANVKLRANALIKRGSMYMQQQQPLLSTQDFNMAADIDPQNADVYHHRGQLKILLDQVEEAVADFDECIRLRPESALAQAQKCFALYRQAYTGNNSSQIQAAMKGFEEVIKKFPRCAEGYALYAQALTDQQQFGKADEMYDKCIDLEPDNATTYVHKGLLQLQWKQDLDRGLELISKAIEIDNKCDFAYETMGTIEVQRGNMEKAIDMFNKAINLAKSEMEMAHLYSLCDAAHAQTEVAKKYGLKPPTL

SEQ ID NO: 848734 - protein, 608 aa, Homo sapiens; identical to SEQ ID NO: 848733

SEQ ID NO: 848735 - protein, 68 aa, Homo sapiens
AKATFDAISKTTGYLTPDLWKETVFTKSPYQEFTDHLVKTHTRVSVQQDSGSSCGYNIGFLYKKNKVN

SEQ ID NO: 848736 - protein, 558 aa, Homo sapiens [sequence omitted]

SEQ ID NO: 848737 - protein, 409 aa, Homo sapiens
MAASKPVEAAVVAAAVPSSGSGVGGGGTAGPGTGGLPRWQLALAVGAPLLLGAGAIYLWSRQQRRREARGRGDASGLKRNSERKTPEGRASPAPGSGHPEGPGAHLDMNSLDRAQAAKNKGNKYFKAGKYEQAIQCYTEAISLCPTEKNVDLSTFYQNRAAAFEQLQKWKEVAQDCTKAVELNPKYVKALFRRAKAHEKLDNKKECLEDVTAVCILEGFQNQQSMLLADKVLKLLGKEKAKEKYKNREPLMPSPQFIKSYFSSFTDDIISQPMLKGEKSDEDKDKEGEALEVKENSGYLKAKQYMEEENYDKIISECSKEIDAEGKYMAEALLLRATFYLLIGNANAAKPDLDKVISLKEANVKLRANALIKRGSMYMQQQQPLLSTQDFNMAADIDPQNADVYHHRGQ

SEQ ID NO: 848738 - protein, 608 aa, Homo sapiens; identical to SEQ ID NO: 848733

SEQ ID NO: 848739 - protein, 608 aa, Homo sapiens; identical to SEQ ID NO: 848733

SEQ ID NO: 848740 - protein, 651 aa, Homo sapiens
FALTLRGPAVLSLALSGARRLFLMLPCELGVCAGCAVDVLCPGAAWGVLPAECACMCSCACLCVQPPCLALCGCCVLSSSYRCCVCLCSAHCAACVMCHDVPVCAELAMLCLECCNMLNCEDPCDVACGHVLCPCVQRDIPECVPGAHLDMNSLDRAQAAKNKGNKYFKAGKYEQAIQCYTEAISLCPTEKNVDLSTFYQNRAAAFEQLQKWKEVAQDCTKAVELNPKYVKALFRRAKAHEKLDNKKECLEDVTAVCILEGFQNQQSMLLADKVLKLLGKEKAKEKYKNREPLMPSPQFIKSYFSSFTDDIISQPMLKGEKSDEDKDKEGEALEVKENSGYLKAKQYMEEENYDKIISECSKEIDAEGKYMAEALLLRATFYLLIGNANAAKPDLDKVISLKEANVKLRANALIKRGSMYMQQQQPLLSTQDFNMAADIDPQNADVYHHRGQLKILLDQVEEAVADFDECIRLRPESALAQAQKCFALYRQAYTGNNSSQIQAAMKGFEEVIKKFPRCAEGYALYAQALTDQQQFGKADEMYDKCIDLEPDNATTYVHKGLLQLQWKQDLDRGLELISKAIEIDNKCDFAYETMGTIEVQRGNMEKAIDMFNKAINLAKSEMEMAHLYSLCDAAHAQTEVAKKYGLKPPTL

SEQ ID NO: 848741 - protein, 608 aa, Homo sapiens; identical to SEQ ID NO: 848733

SEQ ID NO: 848742 - protein, 608 aa, Homo sapiens; identical to SEQ ID NO: 848733

SEQ ID NO: 848743 - protein, 608 aa, Homo sapiens; identical to SEQ ID NO: 848733

SEQ ID NO: 848744 - protein, 525 aa, Homo sapiens
MAASKPVEAAVVAAAVPSSGSGVGGGGTAGPGTGGLPRWQLALAVGAPLLLGAGAIYLWSRQQRRREARGRGDASGLKRNSERKTPEGRASPAPGSGHPEGPGAHLDMNSLDRAQAAKNKGNKYFKAGKYEQAIQCYTEAISLCPTEKNVDLSTFYQNRAAAFEQLQKWKEVAQDCTKAVELNPKYVKALFRRAKAHEKLDNKKECLEDVTAVCILEGFQNQQSMLLADKVLKLLGKEKAKEKYKNREPLMPSPQFIKSYFSSFTDDIISQPMLKGEKSDEDKDKEGEALEVKENSGYLKAKQYMEEENYDKIISECSKEIDAEGKYMAEALLLRATFYLLIGNANAAKPDLDKVISLKEANVKLRANALIKRGSMYMQQQQPLLSTQDFNMAADIDPQNADVYHHRGQLKILLDQVEEAVADFDECIRLRPESALAQAQKCFALYRQAYTGNNSSQIQAAMKGFEEVIKKFPRCAEGYALYAQVNVFSGFLKITAYICQISVWKSENSAIMVAASLEAGGFVPD

SEQ ID NO: 848745 - protein, 158 aa, Homo sapiens
GGGFRNFARVSGLLLCQAGGVLVSSFVMAAAVAMETDDAGNRLRFQLELEFVQCLANPNYLNFLAQRGYFKDKAFVNYLKYLLYWKDPEYAKYLKYPQCLHMLELLQYEHFRKELVNAQCAKFIDEQQILHWQHYSRKRMRLQQALAEQQQQNNTSGK

SEQ ID NO: 848746 - protein, 158 aa, Homo sapiens; identical to SEQ ID NO: 848745

SEQ ID NO: 848747 - protein, 158 aa, Homo sapiens; identical to SEQ ID NO: 848745

SEQ ID NO: 848748 - protein, 70 aa, Homo sapiens
GGGFRNFARVSGLLLCQAGGVLVSSFVMAAAVAMETDDAGNRLRFQLELEFVQCLANPNYLNCTLSVYTC

SEQ ID NO: 848749 - protein, 70 aa, Homo sapiens; identical to SEQ ID NO: 848748

SEQ ID NO: 848750 - protein, 158 aa, Homo sapiens; identical to SEQ ID NO: 848745

SEQ ID NO: 848751 - protein, 158 aa, Homo sapiens; identical to SEQ ID NO: 848745

SEQ ID NO: 848752 - protein, 95 aa, Homo sapiens
GGGFRNFARVSGLLLCQAGGVLVSSFVMAAAVAMETDDAGNRLRFQLELEFVQCLANPNYLNFLAQRGYFKDKAFVNYLKYLLYWKDPEYAKYLK

SEQ ID NO: 848753 - protein, 629 aa, Homo sapiens
RKERGIPTAPPLSVTGGAAASGPRTLNMSRLKRIAGQDLRAGFKAGGRDCGTSVPQGLLKAARKSGQLNLSGRNLSEVPQCVWRINVDIPEEANQNLSFGATERWWEQTDLTKLIISNNKLQSLTDDLRLLPALTVLDIHDNQLTSLPSAIRELENLQKLNVSHNKLKILPEEITNLRNLKCLYLQHNELTCISEGFEQLSNLEDLDLSNNHLTTVPASFSSLSSLVRLNLSSNELKSLPAEINRMKRLKHLDCNSNLLETIPPELAGMESLELLYLRRNKLRFLPEFPSCSLLKELHVGENQIEMLEAEHLKHLNSILVLDLRDNKLKSVPDEIILLRSLERLDLSNNDISSLPYSLGNLHLKFLALEGNPLRTIRREIISKGTQEVLKYLRSKIKDDGPSQSESATETAMTLPSESRVNIHAIITLKILDYSDKQATLIPDEVFDAVKSNIVTSINFSKNQLCEIPKRMVELKEMVSDVDLSFNKLSFISLELCVLQKLTFLDLRNNFLNSLPEEMESLVRLQTINLSFNRFKMLPEVLYRIFTLETILISNNQVGSVDPQKMKMMENLTTLDLQNNDLLQIPPELGNCVNLRTLLLDGNPFRVPRAAILMKGTAAILEYLRDRIPT

SEQ ID NO: 848754 - protein, 384 aa, Homo sapiens
MKRLKHLDCNSNLLETIPPELAGMESLELLYLRRNKLRFLPEFPSCSLLKELHVGENQIEMLEAEHLKHLNSILVLDLRDNKLKSVPDEIILLRSLERLDLSNNDISSLPYSLGNLHLKFLALEGNPLRTIRREIISKGTQEVLKYLRSKIKDDGPSQSESATETAMTLPSESRVNIHAIITLKILDYSDKQATLIPDEVFDAVKSNIVTSINFSKNQLCEIPKRMVELKEMVSDVDLSFNKLSFISLELCVLQKLTFLDLRNNFLNSLPEEMESLVRLQTINLSFNRFKMLPEVLYRIFTLETILISNNQVGSVDPQKMKMMENLTTLDLQNNDLLQIPPELGNCVNLRTLLLDGNPFRVPRAAILMKGTAAILEYLRDRIPT

SEQ ID NO: 848755 - protein, 649 aa, Homo sapiens
MCQKNLIAENCIMNDLVYFTSLEQHWYLLYYLMLVSYEETINTVDSYSLWQLCSIDTLNTQLVNTDLLLLGEIQGLGSCKSLVTTFSATSQYITLLYVCFCSKILHLILLFVINIEIMANSSYNSCLNKAYLTHVFFSKSTFVLRKTRQYFSIILGDHLTQWNHQQRYENLKSVALNEPPKGPVYSIRAETRRQSITLFSLTWEHARGVTPIFCSSVPVYEVTSEVPHIDLGVETLVSRQVCKYSTHEYMRINCNQLFFYEIKKISLYKNSQETEIFEDIIEINNMVESFDFCLHKHLTVKNNKKAFLIEDILLYNETKQALKSSVELSEHVNRFIYVYLLKGGRGQNVLMFWEAGGGAVVVITLITLQSLAWMTHADICLNLIDHLVYSHLIRLRRLDKRVVQITAPSFSSCLILDNISYPPKFVFPHLLKQNYEWYLHHRIVEKIGLLRVTEYKLLGSVPFSKVSIQLICFGLLISYNSNVEMFRYEKGQIAQAWWFTPVIPVLWEAEAGRLLEARSLRPAWPKWQNPLTTENTKISRVWWNTPVIPATREAEDENYLNLGGGGCNKLEIAPLHFRLGNRVRLCLKKRNKNKKGQIEKKYRNFIYKIANEIRLKTLLMENVYILNFSLCLEHYYWMEIHSEFLEQPY

SEQ ID NO: 848756 - protein, 649 aa, Homo sapiens; identical to SEQ ID NO: 848755

SEQ ID NO: 848757 - protein, 1411 aa, Homo sapiens
RQPGTPARATQGRLRRRPEGARVPSARRGRPRARWRAPQNNPEVDSIMAELKVEAPASVDWQKRCLTLETQLFRFRLQASKIRELLADKMQELEQRLLEAEQRAENAETQVGVMEEKVKLSNLKNVDSEGSLHRKYQELLKAIKGKDELISQLEAQLEKQKQMRAEEAKTVQEKAAKIKEWVTLKLAKLEMENQHLKSHNQRLVEQVGSLQDALEAIQIAPSRKLLVPPYGAAEQDSVPSEPGIQPMGQDSGSQAQGLKAAVLAPSPGALQSKDSVSEAASPLEDSSSSTVHSGETVEAKPLQPHLGRESPPHQPCMKLLTFRCSSASWGEGLVTAQRGMLPGTKTSAREGGPGSSLTLPKVRAPGTPRDSIQLAKRHHSQPQVGHGHFGRVVNIETEAFSALHPSGLPELESRARSREEPEKMEMEEPPPAGKNEERESPKALGAELEEVELGNKPPTPPLHQFSSWESRIYAVATSGMRLSDMSPRSNTACCASSPPALVSPGSFSGLVYKNVTVPVYTALKGRATQISNMPFMDESSGSDDDCSSQASFRISVPSSESRKTSGLGSPRAIKRGVSMSSLSSEGDYAIPPDACSLDSDYSEPEHKLQRTSSYSTDGLGLGGESLEKSGYLLKMGSQVKTWKRRWFVLRQGQIMYYKSPSDVIRKPQGQVDLNSRCQIVRGEGSQTFQLISEKKTYYLTADSPSLLEEWIRVLQSLLKVQATGPPALLRGGTKPTVKGWLTKVKHGHSKVVWCALVGKIFYYYRSHEDKRPLGCLPVRDAHIEEVDRSCDSDEDYEAGGTRRLLSSHCTLVIHPTEHSPTYLLIGTKHEKDTWLYHLTVAAGGSSAKVGTAYEQLIGKLMDGEGDPDSPLWRHPMLCYSKDGLYASLTTLPSEALQTEALKLFKSCQLFINVPVEAASVDYHVSLAQTALQVCLVHPELQSEIYCQLMKQTSCRPPQKYSLMQCWQLLALCAPLFLPQHHFLWYVKQQLQRHADPRSETGQYATYCQRAVERTLRTGEREARPSRMEVVSILLRNPFHHSLPFSIPVHFTNGTYHVVGFDGSSTVDEFLQRLNQEIGMRKPSHSGFALFTDDPSGRDLEHCLQGSVKICDAISKWEQAMKELHPGKSEGGTRVVKLMYKNRLYFRSQVKGETDRERLLLASQTSREIVAGRFPINKELALEMAALMAQVEYGDLEKPALPGPGGTSPAKAQHLLQQVLDRFHPRRYRHGAPAEQLRHLADMLTTKWATLQGCSPPECIRIYLTVARKWPFFGAKLFAAQPAQLSSKENALVWIAVNEDGVSILDHNTMQVHITYPYSSVTTFGGCRDDFMLVIRSIPDKSSGKSHIEKLIFRMAAPKIAEATFIMASYMNHCTTTVNPPTNPPGACQLWELDGRQFFSSVSCATKGPTLL

SEQ ID NO: 848758 - protein, 932 aa, Homo sapiens [sequence omitted]

SEQ ID NO: 848759 - protein, 1411 aa, Homo sapiens; identical to SEQ ID NO: 848757

SEQ ID NO: 848760 - protein, 1411 aa, Homo sapiens; identical to SEQ ID NO: 848757

SEQ ID NO: 848761 - protein, 1411 aa, Homo sapiens; identical to SEQ ID NO: 848757

SEQ ID NO: 848762 - protein, 1079 aa, Homo sapiens
RQPGTPARATQGRLRRRPEGARVPSARRGRPRARWRAPQNNPEVDSIMAELKVEAPASVDWQKRCLTLETQLFRFRLQASKIRELLADKMQELEQRLLEAEQRAENAETQVGVMEEKVKLSNLKNVDSEGSLHRKYQELLKAIKGKDELISQLEAQLEKQKQMRAEEAKTVQEKAAKIKEWVTLKLAKLEMENQHLKSHNQRLVEQVGSLQDALEAIQIAPSRKLLVPPYGAAEQDSVPSEPGIQPMGQDSGSQAQGLKAAVLAPSPGALQSKDSVSEAASPLEDSSSSTVHSGETVEAKPLQPHLGRESPPHQPCMKLLTFRCSSASWGEGLVTAQRGMLPGTKTSAREGGPGSSLTLPKVRAPGTPRDSIQLAKRHHSQPQVGHGHFGRVVNIETEAFSALHPSGLPELESRARSREEPEKMEMEEPPPAGKNEERESPKALGAELEEVELGNKPPTPPLHQFSSWESRIYAVATSGMRLSDMSPRSNTACCASSPPALVSPGSFSGLVYKNVTVPVYTALKGRATQISNMPFMDESSGSDDDCSSQASFRISVPSSESRKTSGLGSPRAIKRGVSMSSLSSEGDYAIPPDACSLDSDYSEPEHKLQRTSSYSTDGLGLGGESLEKSGYLLKMGSQVKTWKRRWFVLRQGQIMYYKSPSDVIRKPQGQVDLNSRCQIVRGEGSQTFQLISEKKTYYLTADSPSLLEEWIRVLQSLLKVQATGPPALLRGGTKPTVKGWLTKVKHGHSKVVWCALVGKIFYYYRSHEDKRPLGCLPVRDAHIEEVDRSCDSDEDYEAGGTRRLLSSHCTLVIHPTEHSPTYLLIGTKHEKDTWLYHLTVAAGGSSAKVGTAYEQLIGKLMDGEGDPDSPLWRHPMLCYSKDGLYASLTTLPSEALQTEALKLFKSCQLFINVPVEAASVDYHVSLAQTALQVCLVHPELQSEIYCQLMKQTSCRPPQKYSLMQCWQLLALCAPLFLPQHHFLWYVKQQLQRHADPRSETGQYATYCQRAVERTLRTGEREARPSRMEVVSILLRNPFHHSLPFSIPVHFTNGTYHVRSWACSLPRVFSRHHPENTPGP

SEQ ID NO: 848763 - protein, 552 aa, Homo sapiens
RQPGTPARATQGRLRRRPEGARVPSARRGRPRARWRAPQNNPEVDSIMAELKVEAPASVDWQKRCLTLETQLFRFRLQASKIRELLADKMQELEQRLLEAEQRAENAETQVGVMEEKVKLSNLKNVDSEGSLHRKYQELLKAIKGKDELISQLEAQLEKQKQMRAEEAKTVQEKAAKIKEWVTLKLAKLEMENQHLKSHNQRLVEQVGSLQDALEAIQIAPSRKLLVPPYGAAEQDSVPSEPGIQPMGQDSGSQAQGLKAAVLAPSPGALQSKDSVSEAASPLEDSSSSTVHSGETVEAKPLQPHLGRESPPHQPCMKLLTFRCSSASWGEGLVTAQRGMLPGTKTSAREGGPGSSLTLPKVRAPGTPRDSIQLAKRHHSQPQVGHGHFGRVVNIETEAFSALHPSGLPELESRARSREEPEKMEMEEPPPAGKNEERESPKALGAELEEVELGNKPPTPPLHQFSSWESRIYAVATSGMRLSDMSPRSNTACCASSPPALVSPGSFSGLVYKNVTVPVYTALKGVRNCCTKRGCLIRKGPWPHHPMTGAGL

SEQ ID NO: 848764 - protein, 238 aa, Homo sapiens
RQPGTPARATQGRLRRRPEGARVPSARRGRPRARWRAPQNNPEVDSIMAELKVEAPASVDWQKRCLTLETQLFRFRLQASKIRELLADKMQELEQRLLEAEQRAENAETQVGVMEEKVKLSNLKNVDSEGSLHRKYQELLKAIKGKDELISQLEAQLEKQKQMRAEEAKTVQEKAAKIKEWVTLKLAKLEMENQHLKSHNQRLVEQVGSLQDALEGRQARVCRCAVRVFGGYGAELRS

SEQ ID NO: 848765 - protein, 879 aa, Homo sapiens
MPFMDESSGSDDDCSSQASFRISVPSSESRKTSGLGSPRAIKRGVSMSSLSSEGDYAIPPDACSLDSDYSEPEHKLQRTSSYSTDGLGLGGESLEKSGYLLKMGSQVKTWKRRWFVLRQGQIMYYKSPSDVIRKPQGQVDLNSRCQIVRGEGSQTFQLISEKKTYYLTADSPSLLEEWIRVLQSLLKVQATGPPALLRGGTKPTVKGWLTKVKHGHSKVVWCALVGKIFYYYRSHEDKRPLGCLPVRDAHIEEVDRSCDSDEDYEAGGTRRLLSSHCTLVIHPTEHSPTYLLIGTKHEKDTWLYHLTVAAGGSSAKVGTAYEQLIGKLMDGEGDPDSPLWRHPMLCYSKDGLYASLTTLPSEALQTEALKLFKSCQLFINVPVEAASVDYHVSLAQTALQVCLVHPELQSEIYCQLMKQTSCRPPQKYSLMQCWQLLALCAPLFLPQHHFLWYVKQQLQRHADPRSETGQYATYCQRAVERTLRTGEREARPSRMEVVSILLRNPFHHSLPFSIPVHFTNGTYHVVGFDGSSTVDEFLQRLNQEIGMRKPSHSGFALFTDDPSGRDLEHCLQGSVKICDAISKWEQAMKELHPGKSEGGTRVVKLMYKNRLYFRSQVKGETDRERLLLASQTSREIVAGRFPINKELALEMAALMAQVEYGDLEKPALPGPGGTSPAKAQHLLQQVLDRFHPRRYRHGAPAEQLRHLADMLTTKWATLQGCSPPECIRIYLTVARKWPFFGAKLFAAQPAQLSSKENALVWIAVNEDGVSILDHNTMQVHITYPYSSVTTFGGCRDDFMLVIRSIPDKSSGKSHIEKLIFRMAAPKIAEATFIMASYMNHCTTTVNPPTNPPGACQLWELDGRQFFSSVSCATKGPTLL

SEQ ID NO: 848766 - protein, 143 aa, Homo sapiens [sequence omitted]

SEQ ID NO: 848767 - protein, 1411 aa, Homo sapiens; identical to SEQ ID NO: 848757

SEQ ID NO: 848768 - protein, 1378 aa, Homo sapiens
RQPGTPARATQGRLRRRPEGARVPSARRGRPRARWRAPQNNPEVDSIMAELKVEAPASVDWQKRCLTLETQLFRFRLQASKIRELLADKMQELEQRLLEAEQRAENAETQVGVMEEKVKLSNLKNVDSEGSLHRKYQELLKAIKGKDELISQLEAQLEKQKQMRAEEAKTVQEKAAKIKEWVTLKLAKLEMENQHLKSHNQRLVEQVGSLQDALEAIQIAPSRKLLVPPYGAAEQDSVPSEPGIQPMGQDSGSQAQGLKAAVLAPSPGALQSKDSVSEAASPLEDSSSSTVHSGETVEAKPLQPHLGRESPPHQPCMKLLTFRCSSASWGEGLVTAQRGMLPGTKTSAREGGPGSSLTLPKVRAPGTPRDSIQLAKRHHSQPQVGHGHFGRVVNIETEAFSALHPSGLPELESRARSREEPEKMEMEEPPPAGKNEERESPKALGAELEEVELGNKPPTPPLHQFSSWESRIYAVATSGMRLSDMSPRSNTACCASSPPALVSPGSFSGLVYKNVTVPVYTALKGRATQISNMPFMDESSGSDDDCSSQASFRISVPSSESRKTSGLGSPRAIKRGVSMSSLSSEGDYAIPPDACSLDSDYSEPEHKLQRTSSYSTDGLGLGGESLEKSGYLLKMGSQVKTWKRRWFVLRQGQIMYYKSPSDVIRKPQGQVDLNSRCQIVRGEGSQTFQLISEKKTYYLTADSPSLLEEWIRVLQSLLKVQATGPPALLRGGTKPTVKGWLTKVKHGHSKVVWCALVGKIFYYYRSHEDKRPLGCLPVRDAHIEEVDRSCDSDEDYEAGGTRRLLSSHCTLVIHPTEHSPTYLLIGTKHEKDTWLYHLTVAAGGSSAKVGTAYEQLIGKLMDGEGDPDSPLWRHPMLCYSKDGLYASLTTLPSEALQTEALKLFKSCQLFINVPVEAASVDYHVSLAQTALQVCLVHPELQSEIYCQLMKQTSCRPPQKYSLMQCWQLLALCAPLFLPQHHFLWYVKQQLQRHADPRSETGQYATYCQRAVERTLRTGEREARPSRMEVVSILLRNPFHHSLPFSIPVHFTNGTYHVVGFDGSSTVDEFLQRLNQEIGMRKPSHSGFALFTDDPSGRDLEHCLQGSVKICDAISKWEQAMKELHPGKSEGGTRVVKLMYKNRLYFRSQVKGETDRERLLLASQTSREIVAGRFPINKELALEMAALMAQVEYGDLEKPALPGPGGTSPAKAQHLLQQVLDRFHPRRYRHGAPAEQLRHLADMLTTKWATLQGCSPPECIRIYLTVARKWPFFGAKLFAAQPAQLSSKENALVWIAVNEDGVSILDHNTMQVHITYPYSSVTTFGGCRDDFMLVIRSIPDKSSGKSHIEKLIFRMAAPKKGTVHLRGSPDQQEPTPLGL

SEQ ID NO: 848769 - protein, 488 aa, Homo sapiens
RQPGTPARATQGRLRRRPEGARVPSARRGRPRARWRAPQNNPEVDSIMAELKVEAPASVDWQKRCLTLETQLFRFRLQASKIRELLADKMQELEQRLLEAEQRAENAETQVGVMEEKVKLSNLKNVDSEGSLHRKYQELLKAIKGKDELISQLEAQLEKQKQMRAEEAKTVQEKAAKIKEWVTLKLAKLEMENQHLKSHNQRLVEQVGSLQDALEAIQIAPSRKLLVPPYGAAEQDSVPSEPGIQPMGQDSGSQAQGLKAAVLAPSPGALQSKDSVSEAASPLEDSSSSTVHSGETVEAKPLQPHLGRESPPHQPCMKLLTFRCSSASWGEGLVTAQRGMLPGTKTSAREGGPGSSLTLPKVRAPGTPRDSIQLAKRHHSQPQVGHGHFGRVVNIETEAFSALHPSGLPELESRARSREEPEKMEMEEPPPAGKNEERESPKALGAELEEVELGNKPPTPPLHQFSSWVRGNLRAGQRSRANGKNTAG

SEQ ID NO: 848770 - protein, 100 aa, Homo sapiens
MGLSYGALNVTVFTRITAIQIAPSRKLLVPPYGAAEQDSVPSEPGIQPMGQDSGSQAQGLKAAVLAPSPGALQSKDSVSEAASPLEDSSSSTVHSGETVE

SEQ ID NO: 848771 - protein, 358 aa, Homo sapiens [sequence omitted]

SEQ ID NO: 848772 - protein, 79 aa, Homo sapiens
AFELPLGAFELRLGLSSCHPVFLGPLCEQPGMSCFRSSVLPSSLPFPKRTKDKGDSHTPGLKKAFQNHFSLWAQQRNEG

SEQ ID NO: 848773 - protein, 316 aa, Homo sapiens
MLSLNNLQNIIYNPVIPYVGTIPDQLDPGTLIVICGHVPSDADRFQVDLQNGSSVKPRADVAFHFNPRFKRAGCIVCNTLINEKWGREEITYDTPFKREKSFEIVIMVLKDKFQVAVNGKHTLLYGHRIGPEKIDTLGIYGKVNIHSIGFSFSSDLQSTQASSLELTEISRENVPKSGTPQLSLPFAARLNTPMGPGRTVVVKGEVNANAKSFNVDLLAGKSKDIALHLNPRLNIKAFVRNSFLQESWGEEERNITSFPFSPGMYFEMIIYCDVREFKVAVNGVHSLEYKHRFKELSSIDTLEINGDIHLLEVRSW

SEQ ID NO: 848774 - protein, 316 aa, Homo sapiens; identical to SEQ ID NO: 848773

SEQ ID NO: 848775 - protein, 316 aa, Homo sapiens; identical to SEQ ID NO: 848773

SEQ ID NO: 848776 - protein, 316 aa, Homo sapiens; identical to SEQ ID NO: 848773

SEQ ID NO: 848777 - protein, 316 aa, Homo sapiens; identical to SEQ ID NO: 848773

SEQ ID NO: 848778 - protein, 358 aa, Homo sapiens [sequence omitted]

SEQ ID NO: 848779 - protein, 299 aa, Homo sapiens
MLSLNNLQNIIYNPVIPYVGTIPDQLDPGTLIVICGHVPSDADRFQVDLQNGSSVKPRADVAFHFNPRFKRAGCIVCNTLINEKWGREEITYDTPFKREKSFEIVIMVLKDKFQVPKSGTPQLPSNRGGDISKIAPRTVYTKSKDSTVNHTLTCTKIPPMNYVSKSLPFAARLNTPMGPGRTVVVKGEVNANAKSFNVDLLAGKSKDIALHLNPRLNIKAFVRNSFLQESWGEEERNITSFPFSPGMYFEMIIYCDVREFKVAVNGVHSLEYKHRFKELSSIDTLEINGDIHLLEVRSW

SEQ ID NO: 848780 - protein, 123 aa, Homo sapiens [sequence omitted]

SEQ ID NO: 848781 - protein, 316 aa, Homo sapiens; identical to SEQ ID NO: 848773

SEQ ID NO: 848782 - protein, 177 aa, Homo sapiens
MLSLNNLQNIIYNPVIPYVGTIPDQLDPGTLIVICGHVPSDADRFQVDLQNGSSVKPRADVAFHFNPRFKRAGCIVCNTLINEKWGREEITYDTPFKREKSFEIVIMVLKDKFQVAVNGKHTLLYGHRIGPEKIDTLGIYGKVNIHSIGFSFSSDLQSTQASSLELTEISRENKCKY

SEQ ID NO: 848783 - protein, 316 aa, Homo sapiens; identical to SEQ ID NO: 848773

SEQ ID NO: 848784 - protein, 246 aa, Homo sapiens
MLSLNNLQNIIYNPVIPYVGTIPDQLDPGTLIVICGHVPSDADRFQVDLQNGSSVKPRADVAFHFNPRFKRAGCIVCNTLINEKWGREEITYDTPFKREKSFEIVIMVLKDKFQVAVNGKHTLLYGHRIGPEKIDTLGIYGKVNIHSIGFSFSSDLQSTQASSLELTEISRENVPKSGTPQLADCLSPPGIYRVMALKHSVVFFGHEFSLEIAFCRPLGPDCGFFSEPAIRCKVEHPHGPWTNCRR

SEQ ID NO: 848785 - protein, 316 aa, Homo sapiens; identical to SEQ ID NO: 848773

SEQ ID NO: 848786 - protein, 316 aa, Homo sapiens; identical to SEQ ID NO: 848773

SEQ ID NO: 848787 - protein, 316 aa, Homo sapiens; identical to SEQ ID NO: 848773

SEQ ID NO: 848788 - protein, 316 aa, Homo sapiens; identical to SEQ ID NO: 848773

SEQ ID NO: 848789 - protein, 212 aa, Homo sapiens
MLSLNNLQNIIYNPVIPYVGTIPDQLDPGTLIVICGHVPSDADRFQVDLQNGSSVKPRADVAFHFNPRFKRAGCIVCNTLINEKWGREEITYDTPFKREKSFEIVIMVLKDKFQVAVNGKHTLLYGHRIGPEKIDTLGIYGKVNIHSIGFSFSSDLQSTQASSLELTEISRENVPKSGTPQLSLPFAARLNTPMGPGRTVVVKGEVNANAKS

SEQ ID NO: 848790 - protein, 316 aa, Homo sapiens; identical to SEQ ID NO: 848773

SEQ ID NO: 848791 - protein, 316 aa, Homo sapiens; identical to SEQ ID NO: 848773

SEQ ID NO: 848792 - protein, 358 aa, Homo sapiens [sequence omitted]

SEQ ID NO: 848793 - protein, 278 aa, Homo sapiens
MLSLNNLQNIIYNPVIPYVGTIPDQLDPGTLIVICGHVPSDADRFQVDLQNGSSVKPRADVAFHFNPRFKRAGCIVCNTLINEKWGREEITYDTPFKREKSFEIVIMVLKDKFQVAVNGKHTLLYGHRIGPEKIDTLGIYGKVNIHSIGFSFSSDLQSTQASSLELTEISRENVPKSGTPQLSLPFAARLNTPMGPGRTVVVKGEVNANAKSFNVDLLAGKSKDIALHLNPRLNIKAFVRNSFLQESWGEEERNITSFPFSPGMYFEVRLQFLKMGQQ

SEQ ID NO: 848794 - protein, 216 aa, Homo sapiens
MLSLNNLQNIIYNPVIPYVGTIPDQLDPGTLIVICGHVPSDADRFQVDLQNGSSVKPRADVAFHFNPRFKRAGCIVCNTLINEKWGREEITYDTPFKREKSFEIVIMVLKDKFQVAVNGKHTLLYGHRIGPEKIDTLGIYGKVNIHSIGFSFSSDLQSTQASSLELTEISRENGHPHWPLTNCLCLREVDSKRKAFKVTFLPGNLRLLVFTWTPPL

SEQ ID NO: 848795 - protein, 138 aa, Homo sapiens
MLSLNNLQNIIYNPVIPYVGTIPDQLDPGTLIVICGHVPSDADRFQVDLQNGSSVKPRADVAFHFNPRFKRAGCIVCNTLINEKWGREEITYDTPFKREKSFEIVIMVLKDKFQVGFGEGQVESSLVSRSAQGGLSHL

SEQ ID NO: 848796 - protein, 176 aa, Homo sapiens
MERKPDCTLNPRTFSTLQNKSSAGAGSGIREASCTAGRPGPRLGSSLSAVFSAVLQVPWCSPRSVINAAEIHRLPRSRGGTCQAGVHAPPRLPADRVLGGGINHAGTQSHEGRISATSSRCASRTLRGGRRQPPGAAADARGSVAWAGGSAALSERHQREGRPENKGGRGAATASA

SEQ ID NO: 848797 - protein, 176 aa, Homo sapiens; identical to SEQ ID NO: 848796

SEQ ID NO: 848798 - protein, 138 aa, Homo sapiens
HRWRVGWWVGVVRSLAGADTQLAGSFLSLASSCPQPFPFLLLADCWSPLLPSFQLFLVTTYPWPWTDQTSIQNKSLFQVDSVVLPAQPLQVEVLPRERSCSACPGAPGDSWEQGSAVRSPAFPVRQAWLPCSGSLTSW

SEQ ID NO: 848799 - protein, 138 aa, Homo sapiens; identical to SEQ ID NO: 848798

SEQ ID NO: 848800 - protein, 138 aa, Homo sapiens; identical to SEQ ID NO: 848798

SEQ ID NO: 848801 - protein, 680 aa, Homo sapiens
MESSSSSNSYFSVGPTSPSAVVLLYSKELKKWDEFEDILEERRHVSDLKFAMKCYTPLVYKGITPCKPIDIKCSVLNSEEIHYVIKQLSKESLQSVDVLREEVSEILDEMSHKLRLGAIRFCAFTLSKVFKQIFSKVCVNEEGIQKLQRAIQEHPVVLLPSHRSYIDFLMLSFLLYNYDLPVPVIAAGMDFLGMKMVGELLRMSGAFFMRRTFGGNKLYWAVFSEYVKTMLRNGYAPVEFFLEGTRSRSAKTLTPKFGLLNIVMEPFFKREVFDTYLVPISISYDKILEETLYVYELLGVPKPKESTTGLLKARKILSENFGSIHVYFGDPVSLRSLAAGRMSRSSYNLVPRYIPQKQSEDMHAFVTEVAYKMELLQIENMVLSPWTLIVAVLLQNRPSMDFDALVEKTLWLKGLTQAFGGFLIWPDNKPAEEVVPASILLHSNIASLVKDQVILKVDSGDSEVVDGLMLQHITLLMCSAYRNQLLNIFVRPSLVAVALQMTPGFRKEDVYSCFRFLRDVFADEFIFLPGNTLKDFEEGCYLLCKSEAIQVTTKDILVTEKGNTVLEFLVGLFKPFVESYQIICKYLLSEEEDHFSEEQYLAAVRKFTSQLLDQGTSQCYDVLSSDVQKNALAACVRLGVVEKKKINNNCIFNVNEPATTKLEEMLGCKTPIGKPATAKL

SEQ ID NO: 848802 - protein, 492 aa, Homo sapiens
MDFLGMKMVGELLRMSGAFFMRRTFGGNKLYWAVFSEYVKTMLRNGYAPVEFFLEGTRSRSAKTLTPKFGLLNIVMEPFFKREVFDTYLVPISISYDKILEETLYVYELLGVPKPKESTTGLLKARKILSENFGSIHVYFGDPVSLRSLAAGRMSRSSYNLVPRYIPQKQSEDMHAFVTEVAYKMELLQIENMVLSPWTLIVAVLLQNRPSMDFDALVEKTLWLKGLTQAFGGFLIWPDNKPAEEVVPASILLHSNIASLVKDQVILKVDSGDSEVVDGLMLQHITLLMCSAYRNQLLNIFVRPSLVAVALQMTPGFRKEDVYSCFRFLRDVFADEFIFLPGNTLKDFEEGCYLLCKSEAIQVTTKDILVTEKGNTVLEFLVGLFKPFVESYQIICKYLLSEEEDHFSEEQYLAAVRKFTSQLLDQGTSQCYDVLSSDVQKNALAACVRLGVVEKKKINNNCIFNVNEPATTKLEEMLGCKTPIGKPATAKL

SEQ ID NO: 848803 - protein, 133 aa, Homo sapiens
MHAFVTEVAYKMELLQIENMVLSPWTLIVAVLLQNRPSMDFDALVEKTLWLKGLTQAFGGFLIWPDNKPAEEVVPASILLHSNIASLVKDQVILKVDSGDSEVVDGLMLQHITLLMCSAYRNQVMLYRDPLGT

SEQ ID NO: 848804 - protein, 494 aa, Homo sapiens
MESSSSSNSYFSVGPTSPSAVVLLYSKELKKWDEFEDILEERRHVSDLKFAMKCYTPLVYKGITPCKPIDIKCSVLNSEEIHYVIKQLSKESLQSVDVLREEVSEILDEMSHKLRLGAIRFCAFTLSKVFKQIFSKVCVNEEGIQKLQRAIQEHPVVLLPSHRSYIDFLMLSFLLYNYDLPVPVIAAGMDFLGMKMVGELLRMSGAFFMRRTFGGNKLYWAVFSEYVKTMLRNGYAPVEFFLEGTRSRSAKTLTPKFGLLNIVMEPFFKREVFDTYLVPISISYDKILEETLYVYELLGVPKPKESTTGLLKARKILSENFGSIHVYFGDPVSLRSLAAGRMSRSSYNLVPRYIPQKQSEDMHAFVTEVAYKMELLQIENMVLSPWTLIVAVLLQNRPSMDFDALVEKTLWLKGLTQAFGGFLIWPDNKPAEEVVPASILLHSNIASLVKDQVILKVDSGDSEVVDGLMLQHITLLMCSAYRNQVMLYRDPLGT

SEQ ID NO: 848805 - protein, 281 aa, Homo sapiens [sequence omitted]

SEQ ID NO: 848806 - protein, 110 aa, Homo sapiens
EVHIPKTTTNTSPCEGDGINYLITESRCDVSVNILDWSSENMTGFNSWPWPCGSGHAVTSWSIYRFPCGGGWRPHGYWPACEALHKSPASPLDSRPRNSCMRKGKISIIS

SEQ ID NO: 848807 - protein, 680 aa, Homo sapiens; identical to SEQ ID NO: 848801

SEQ ID NO: 848808 - protein, 680 aa, Homo sapiens; identical to SEQ ID NO: 848801

SEQ ID NO: 848809 - protein, 622 aa, Homo sapiens
MESSSSSNSYFSVGPTSPSAVVLLYSKELKKWDEFEDILEERRHVSDLKFAMKCYTPLVYKGITPCKPIDIKCSVLNSEEIHYVIKQLSKESLQSVDVLREEVSEILDEMSHKLRLGAIRFCAFTLSKVFKQIFSKVCVNEEGIQKLQRAIQEHPVVLLPSHRSYIDFLMLSFLLYNYDLPVPVIAAGMDFLGMKMVGELLRMSGAFFMRRTFGGNKLYWAVFSEYVKTMLRNGYAPVEFFLEGTRSRSAKTLTPKFGLLNIVMEPFFKREVFDTYLVPISISYDKILEETLYVYELLGVPKPKESTTGLLKARKILSENFGSIHVYFGDPVSLRSLAAGRMSRSSYNLVPRYIPQKQSEDMHAFVTEVAYKMELLQIENMVLSPWTLIVAVLLQNRPSMDFDALVEKTLWLKGLTQAFGGFLIWPDNKPAEEVVPASILLHSNIASLVKDQVILKVDSGDSEVVDGLMLQHITLLMCSAYRNQLLNIFVRPSLVAVALQMTPGFRKEDVYSCFRFLRDVFADEFIFLPGNTLKDFEEGCYLLCKSEAIQVTTKDILVTEKGNTVLEFLVGLFKPFVESYQIICKYLLSEEEDHFSEEQYLAAVRKFTSQLLDQGQSLLCGC

SEQ ID NO: 848810 - protein, 619 aa, Homo sapiens
MESSSSSNSYFSVGPTSPSAVVLLYSLSKESLQSVDVLREEVSEILDEMSHKLRLGAIRFCAFTLSKVFKQIFSKVCVNEEGIQKLQRAIQEHPVVLLPSHRSYIDFLMLSFLLYNYDLPVPVIAAGMDFLGMKMVGELLRMSGAFFMRRTFGGNKLYWAVFSEYVKTMLRNGYAPVEFFLEGTRSRSAKTLTPKFGLLNIVMEPFFKREVFDTYLVPISISYDKILEETLYVYELLGVPKPKESTTGLLKARKILSENFGSIHVYFGDPVSLRSLAAGRMSRSSYNLVPRYIPQKQSEDMHAFVTEVAYKMELLQIENMVLSPWTLIVAVLLQNRPSMDFDALVEKTLWLKGLTQAFGGFLIWPDNKPAEEVVPASILLHSNIASLVKDQVILKVDSGDSEVVDGLMLQHITLLMCSAYRNQLLNIFVRPSLVAVALQMTPGFRKEDVYSCFRFLRDVFADEFIFLPGNTLKDFEEGCYLLCKSEAIQVTTKDILVTEKGNTVLEFLVGLFKPFVESYQIICKYLLSEEEDHFSEEQYLAAVRKFTSQLLDQGTSQCYDVLSSDVQKNALAACVRLGVVEKKKINNNCIFNVNEPATTKLEEMLGCKTPIGKPATAKL

SEQ ID NO: 848811 - protein, 646 aa, Homo sapiens [sequence omitted]

SEQ ID NO: 848812 - protein, 492 aa, Homo sapiens; identical to SEQ ID NO: 848802

SEQ ID NO: 848813 - protein, 622 aa, Homo sapiens; identical to SEQ ID NO: 848809

SEQ ID NO: 848814 - protein, 319 aa, Homo sapiens [sequence omitted]

SEQ ID NO: 848815 - protein, 2871 aa, Homo sapiens
MLEGLVAWVLNTYLGKYVNNLNTDQLSVALLKGAVELENLPLKKDALKELELPFEVKAGFIGKVTLQIPFYRPHVDPWVISISSLHLIGAPEKIQDFNDEKEKLLERERKKALLQALEEKWKNDRQQKGESYWYSVTASVVTRIVENIELKIQDVHLRFEDGVTNPSHPFAFGICIKNVSMQNAVNEPVQKLMRNKQLDVAEFSIYWDVDCTLLGDLPQMELQEAMARSMESRSHHYVLEPVFASALLKRNCSKKPLRSRHSPRIDCDIQLETIPLKLSQLQYRQIMEFLKELERKERQVKFRRWKPKVAISKNCREWWYFALNANLYEIREQRKRCTWDFMLHRARDAVSYTDKYFNKLKGGLLSTDDKEEMCRIEEEQSFEELKILRELVHDRFHKQEELAESLREPQFDSPGACPGAPEPGGGSGMLQYLQSWFPGWGGWYGQQTPEGNVVEGLSAEQQEQWIPEEILGTEEFFDPTADASCMNTYTKRDHVFAKLNLQLQRGTVTLLHKEQGTPQMNESAFMQLEFSDVKLLAESLPRRNSSLLSVRLGGLFLRDLATEGTMFPLLVFPNPQKEVGRVSQSFGLQTTSADRSDHYPAADPDGPVFEMLYERNPAHSHFERRLNVSTRPLNIIYNPQAIKKVADFFYKGKVHTSGFGYQSELELRVAEAARRQYNKLKMQTKAEIRQTLDRLLVGDFIEESKRWTVRLDISAPQVIFPDDFKFKNPVLVVVDLGRMLLTNTQDNSRRKSRDGSASEETQFSDDEYKTPLATPPNTPPPESSSSNGEKTPPFSGVEFSEEQLQAHLMSTKMYERYSLSFMDLQIMVGRVKDNWKHVQDIDVGPTHVVEKFNVHLQLERRLIYTSDPKYPGAVLSGNLPDLKIHINEDKISALKNCFALLTTPEMKTSDTQIKEKIFPQEEQRGSLQDSVMNLTQSIVLLEQHTREVLVESQLLLAEFKVNCMQLGVESNGRYISVLKVFGTNAHFVKRPYDAEVSLTVHGLLLVDTMQTYGADFDLLMASHKNLSFDIPTGSLRDSRAQSPVSGPNVAHLTDGATLNDRSATSVSLDKILTKEQESLIKLEYQFVSSECPSMNLDSTLQVISLQVNNLDIILNPETIVELIGFLQKSFPKEKDDLSPQPLMTDFERSFREQGTYQSTYEQNTEVAVEIHRLNLLLLRTVGMANREKYGRKIATASIGGTKVNVSMGSTFDMNGSLGCLQLMDLTQDNVKNQYVVSIGNSVGYENIISDIGYFESVFVRMEDAALTEALSFTFVERSKQECFLNLKMASLHYNHSAKFLKELTLSMDELEENFRGMLKSAATKVTTVLATKTAEYSEMVSLFETPRKTREPFILEENEIYGFDLASSHLDTVKLILNINIESPVVSIPRKPGSPELLVGHLGQIFIQNFVAGDDESRSDRLQVEIKDIKLYSLNCTQLAGREAVGSEGSRMFCPPSGSGSANSQEEAHFTRHDFFESLHRGQAFHILNNTTIQFKLEKIPIERESELTFSLSPDDLGTSSIMKIEGKFVNPVQVVLAKHVYEQVLQTLDNLVYSEDLNKYPASATSSPCPDSPLPPLSTCGESSVERKENGLFSHSSLSNTSQKSLSVKEVKSFTQIQATFCISELQVQLSGDLTLGAQGLVSLKFQDFEVEFSKDHPQTLSIQIALHSLLMEDLLEKNPDSKYKNLMVSRGAPKPSSLAQKEYLSQSCPSVSNVEYPDMPRSLPSHMEEAPNVFQLYQRPTSASRKKQKEVQDKDYPLTPPPSPTVDEPKILVGKSKFDDSLVHINIFLVDKKHPEFSSSYNRVNRSIDVDFNCLDVLITLQTWVVILDFFGIGSTADNHAMRLPPEGILHNVKLEPHASMESGLQDPVNTKLDLKVHSLSLVLNKTTSELAKANVSKLVAHLEMIEGDLALQGSIGSLSLSDLTCHGEFYRERFTTSGEEALIFQTFKYGRPDPLLRREHDIRVSLRMASVQYVHTQRFQAEVVAFIQHFTQLQDVLGRQRAAIEGQTVRDQAQRCSRVLLDIEAGAPVLLIPESSRSNNLIVANLGKLKVKNKFLFAGFPGTFSLQDKESVPSASPTGIPKHSLRKTTSTEEPRGTHSQGQFTMPLAGMSLGSLKSEFVPSTSTKQQGPQPTLSVGQESSSPEDHVCLLDCVVVDLQDMDIFAAERHPREYSKAPEDSSGDLIFPSYFVRQTGGSLLTEPCRLKLQVERNLDKEISHTVPDISIHGNLSSVHCSLDLYKYKLIRGLLENNLGEPIEEFMRPYDLQDPRIHTVLSGEVYTCMCFLIDMVNVSLELKDPKRKEGAGSLARFDFKKCKLLYESFSNQTKSINLVSHSMMAFDTRYAGQKTSPGMTNVFSCIFQPAKNSSTTQGSIQIELHFRSTKDSSCFTVVLNNLRVFLIFDWLLLVHDFLHTPSDIKKQNHVTPSRHRNSSSESAIVPKTVKSGVVTKRSSLPVSNERHLEVKVNVTGTEFVVIEDVSCFDTNAIILKGTTVLTYKPRFVDRPFSGSLFGIEVFSCRLGNEHDTALSIVDPVQIQMELVGNSSYQNSSGLMDAFNSEDFPPVLEIQLQALDIRLSYNDVQLFLAIAKSIPEQANAAVPDSVALESDSVGTYLPGASRVGEEIREGTRHTLDPVLELQLARLQELGFSMDDCRKALLACQGQLKKAASWLFKNAEPLKSLSLASTSRDSPGAVAAPLISGVEIKAESVCICFIDDCMDCDVPLAELTFSRLNFLQRVRTSPEGYAHFTLSGDYYNRALSGWEPFIEPWPCSVSWQQQAAGRLHPPRLKLEAKAKPRLDINITSVLIDQYVSTKESWMADYCKDDKDIESAKSEDWMGSSVDPPCFGQSKSFHYMCLTKSLLTYKAMLH

SEQ ID NO: 848816 - protein, 2664 aa, Homo sapiens
QKESHSEQSRCSCDTQEAMARSMESRSHHYVLEPVFASALLKRNCSKKPLRSRHSPRIDCDIQLETIPLKLSQLQYRQIMEFLKELERKERQVKFRRWKPKVAISKNCREWWYFALNANLYEIREQRKRCTWDFMLHRARDAVSYTDKYFNKLKGGLLSTDDKEEMCRIEEEQSFEELKILRELVHDRFHKQEELAESLREPQFDSPGACPGAPEPGGGSGMLQYLQSWFPGWGGWYGQQTPEGNVVEGLSAEQQEQWIPEEILGTEEFFDPTADASCMNTYTKRDHVFAKLNLQLQRGTVTLLHKEQGTPQMNESAFMQLEFSDVKLLAESLPRRNSSLLSVRLGGLFLRDLATEGTMFPLLVFPNPQKEVGRVSQSFGLQTTSADRSDHYPAADPDGPVFEMLYERNPAHSHFERRLNVSTRPLNIIYNPQAIKKVADFFYKGKVHTSGFGYQSELELRVAEAARRQYNKLKMQTKAEIRQTLDRLLVGDFIEESKRWTVRLDISAPQVIFPDDFKFKNPVLVVVDLGRMLLTNTQDNSRRKSRDGSASEETQFSDDEYKTPLATPPNTPPPESSSSNGEKTPPFSGVEFSEEQLQAHLMSTKMYERYSLSFMDLQIMVGRVKDNWKHVQDIDVGPTHVVEKFNVHLQLERRLIYTSDPKYPGAVLSGNLPDLKIHINEDKISALKNCFALLTTPEMKTSDTQIKEKIFPQEEQRGSLQDSVMNLTQSIVLLEQHTREVLVESQLLLAEFKVNCMQLGVESNGRYISVLKVFGTNAHFVKRPYDAEVSLTVHGLLLVDTMQTYGADFDLLMASHKNLSFDIPTGSLRDSRAQSPVSGPNVAHLTDGATLNDRSATSVSLDKILTKEQESLIKLEYQFVSSECPSMNLDSTLQVISLQVNNLDIILNPETIVELIGFLQKSFPKEKDDLSPQPLMTDFERSFREQGTYQSTYEQNTEVAVEIHRLNLLLLRTVGMANREKYGRKIATASIGGTKVNVSMGSTFDMNGSLGCLQLMDLTQDNVKNQYVVSIGNSVGYENIISDIGYFESVFVRMEDAALTEALSFTFVERSKQECFLNLKMASLHYNHSAKFLKELTLSMDELEENFRGMLKSAATKVTTVLATKTAEYSEMVSLFETPRKTREPFILEENEIYGFDLASSHLDTVKLILNINIESPVVSIPRKPGSPELLVGHLGQIFIQNFVAGDDESRSDRLQVEIKDIKLYSLNCTQLAGREAVGSEGSRMFCPPSGSGSANSQEEAHFTRHDFFESLHRGQAFHILNNTTIQFKLEKIPIERESELTFSLSPDDLGTSSIMKIEGKFVNPVQVVLAKHVYEQVLQTLDNLVYSEDLNKYPASATSSPCPDSPLPPLSTCGESSVERKENGLFSHSSLSNTSQKSLSVKEVKSFTQIQATFCISELQVQLSGDLTLGAQGLVSLKFQDFEVEFSKDHPQTLSIQIALHSLLMEDLLEKNPDSKYKNLMVSRGAPKPSSLAQKEYLSQSCPSVSNVEYPDMPRSLPSHMEEAPNVFQLYQRPTSASRKKQKEVQDKDYPLTPPPSPTVDEPKILVGKSKFDDSLVHINIFLVDKKHPEFSSSYNRVNRSIDVDFNCLDVLITLQTWVVILDFFGIGSTADNHAMRLPPEGILHNVKLEPHASMESGLQDPVNTKLDLKVHSLSLVLNKTTSELAKANVSKLVAHLEMIEGDLALQGSIGSLSLSDLTCHGEFYRERFTTSGEEALIFQTFKYGRPDPLLRREHDIRVSLRMASVQYVHTQRFQAEVVAFIQHFTQLQDVLGRQRAAIEGQTVRDQAQRCSRVLLDIEAGAPVLLIPESSRSNNLIVANLGKLKVKNKFLFAGFPGTFSLQDKESVPSASPTGIPKHSLRKTTSTEEPRGTHSQGQFTMPLAGMSLGSLKSEFVPSTSTKQQGPQPTLSVGQESSSPEDHVCLLDCVVVDLQDMDIFAAERHPREYSKAPEDSSGDLIFPSYFVRQTGGSLLTEPCRLKLQVERNLDKEISHTVPDISIHGNLSSVHCSLDLYKYKLIRGLLENNLGEPIEEFMRPYDLQDPRIHTVLSGEVYTCMCFLIDMVNVSLELKDPKRKEGAGSLARFDFKKCKLLYESFSNQTKSINLVSHSMMAFDTRYAGQKTSPGMTNVFSCIFQPAKNSSTTQGSIQIELHFRSTKDSSCFTVVLNNLRVFLIFDWLLLVHDFLHTPSDIKKQNHVTPSRHRNSSSESAIVPKTVKSGVVTKRSSLPVSNERHLEVKVNVTGTEFVVIEDVSCFDTNAIILKGTTVLTYKPRFVDRPFSGSLFGIEVFSCRLGNEHDTALSIVDPVQIQMELVGNSSYQNSSGLMDAFNSEDFPPVLEIQLQALDIRLSYNDVQLFLAIAKSIPEQANAAVPDSVALESDSVGTYLPGASRVGEEIREGTRHTLDPVLELQLARLQELGFSMDDCRKALLACQGQLKKAASWLFKNAEPLKSLSLASTSRDSPGAVAAPLISGVEIKAESVCICFIDDCMDCDVPLAELTFSRLNFLQRVRTSPEGYAHFTLSGDYYNRALSGWEPFIEPWPCSVSWQQQAAGRLHPPRLKLEAKAKPRLDINITSVLIDQYVSTKESWMADYCKDDKDIESAKSEDWMGSSVDPPCFGQSKSFHYMCLTKSLLTYKAMLH

SEQ ID NO: 848817 - protein, 364 aa, Homo sapiens
MLEGLVAWVLNTYLGKYVNNLNTDQLSVALLKGAVELENLPLKKDALKELELPFEVKAGFIGKVTLQIPFYRPHVDPWVISISSLHLIGAPEKIQDFNDEKEKLLERERKKALLQALEEKWKARQSLLGHKSSCGDTCKMSKNTEIELMLTLVFENDRQQKGESYWYSVTASVVTRIVENIELKIQDVHLRFEDGVTNPSHPFAFGICIKNVSMQNAVNEPVQKLMRNKQLDVAEFSIYWDVDCTLLGDLPQMELQEAMARSMESRSHHYVLEPVFASALLKRNCSKKPLRSRHSPRIDCDIQLETIPLKLSQLQYRQIMEFLKELERKERQVKFRRWKPKVAISKNAENGAYFAVPLGTEARS

SEQ ID NO: 848818 - protein, 432 aa, Homo sapiens
PEQIQLNTFVMQGCSSAQHNGCQKPSWNWETKLMDLVSHSMVASINTNAIILKGTTVLTYKPRFVDRPFSGSLFGIEVFSCRLGNEHDTALSIVDPVQIQMELVGNSSYQNSSGLMDAFNSEDFPPVLEIQLQALDIRLSYNDVQLFLAIAKSIPEQANAAVPDSVALESDSVGTYLPGASRVGEEIREGTRHTLDPVLELQLARLQELGFSMDDCRKALLACQGQLKKAASWLFKNAEPLKSLSLASTSRDSPGAVAAPLISGVEIKAESVCICFIDDCMDCDVPLAELTFSRLNFLQRVRTSPEGYAHFTLSGDYYNRALSGWEPFIEPWPCSVSWQQQAAGRLHPPRLKLEAKAKPRLDINITSVLIDQYVSTKESWMADYCKDDKDIESAKSEDWMGSSVDPPCFGQSKSFHYMCLTKSLLTYKAMLH

SEQ ID NO: 848819 - protein, 83 aa, Homo sapiens
AALDITDNLSPKQVNSPLRSGTIEVENKTGMVAHAHYPSTLGGHGQEHGESQPSLRPGACVCICSFEEKLLQEAPAVSAQSPY

SEQ ID NO: 848820 - protein, 2646 aa, Homo sapiens
MARSMESRSHHYVLEPVFASALLKRNCSKKPLRSRHSPRIDCDIQLETIPLKLSQLQYRQIMEFLKELERKERQVKFRRWKPKVAISKNCREWWYFALNANLYEIREQRKRCTWDFMLHRARDAVSYTDKYFNKLKGGLLSTDDKEEMCRIEEEQSFEELKILRELVHDRFHKQEELAESLREPQFDSPGACPGAPEPGGGSGMLQYLQSWFPGWGGWYGQQTPEGNVVEGLSAEQQEQWIPEEILGTEEFFDPTADASCMNTYTKRDHVFAKLNLQLQRGTVTLLHKEQGTPQMNESAFMQLEFSDVKLLAESLPRRNSSLLSVRLGGLFLRDLATEGTMFPLLVFPNPQKEVGRVSQSFGLQTTSADRSDHYPAADPDGPVFEMLYERNPAHSHFERRLNVSTRPLNIIYNPQAIKKVADFFYKGKVHTSGFGYQSELELRVAEAARRQYNKLKMQTKAEIRQTLDRLLVGDFIEESKRWTVRLDISAPQVIFPDDFKFKNPVLVVVDLGRMLLTNTQDNSRRKSRDGSASEETQFSDDEYKTPLATPPNTPPPESSSSNGEKTPPFSGVEFSEEQLQAHLMSTKMYERYSLSFMDLQIMVGRVKDNWKHVQDIDVGPTHVVEKFNVHLQLERRLIYTSDPKYPGAVLSGNLPDLKIHINEDKISALKNCFALLTTPEMKTSDTQIKEKIFPQEEQRGSLQDSVMNLTQSIVLLEQHTREVLVESQLLLAEFKVNCMQLGVESNGRYISVLKVFGTNAHFVKRPYDAEVSLTVHGLLLVDTMQTYGADFDLLMASHKNLSFDIPTGSLRDSRAQSPVSGPNVAHLTDGATLNDRSATSVSLDKILTKEQESLIKLEYQFVSSECPSMNLDSTLQVISLQVNNLDIILNPETIVELIGFLQKSFPKEKDDLSPQPLMTDFERSFREQGTYQSTYEQNTEVAVEIHRLNLLLLRTVGMANREKYGRKIATASIGGTKVNVSMGSTFDMNGSLGCLQLMDLTQDNVKNQYVVSIGNSVGYENIISDIGYFESVFVRMEDAALTEALSFTFVERSKQECFLNLKMASLHYNHSAKFLKELTLSMDELEENFRGMLKSAATKVTTVLATKTAEYSEMVSLFETPRKTREPFILEENEIYGFDLASSHLDTVKLILNINIESPVVSIPRKPGSPELLVGHLGQIFIQNFVAGDDESRSDRLQVEIKDIKLYSLNCTQLAGREAVGSEGSRMFCPPSGSGSANSQEEAHFTRHDFFESLHRGQAFHILNNTTIQFKLEKIPIERESELTFSLSPDDLGTSSIMKIEGKFVNPVQVVLAKHVYEQVLQTLDNLVYSEDLNKYPASATSSPCPDSPLPPLSTCGESSVERKENGLFSHSSLSNTSQKSLSVKEVKSFTQIQATFCISELQVQLSGDLTLGAQGLVSLKFQDFEVEFSKDHPQTLSIQIALHSLLMEDLLEKNPDSKYKNLMVSRGAPKPSSLAQKEYLSQSCPSVSNVEYPDMPRSLPSHMEEAPNVFQLYQRPTSASRKKQKEVQDKDYPLTPPPSPTVDEPKILVGKSKFDDSLVHINIFLVDKKHPEFSSSYNRVNRSIDVDFNCLDVLITLQTWVVILDFFGIGSTADNHAMRLPPEGILHNVKLEPHASMESGLQDPVNTKLDLKVHSLSLVLNKTTSELAKANVSKLVAHLEMIEGDLALQGSIGSLSLSDLTCHGEFYRERFTTSGEEALIFQTFKYGRPDPLLRREHDIRVSLRMASVQYVHTQRFQAEVVAFIQHFTQLQDVLGRQRAAIEGQTVRDQAQRCSRVLLDIEAGAPVLLIPESSRSNNLIVANLGKLKVKNKFLFAGFPGTFSLQDKESVPSASPTGIPKHSLRKTTSTEEPRGTHSQGQFTMPLAGMSLGSLKSEFVPSTSTKQQGPQPTLSVGQESSSPEDHVCLLDCVVVDLQDMDIFAAERHPREYSKAPEDSSGDLIFPSYFVRQTGGSLLTEPCRLKLQVERNLDKEISHTVPDISIHGNLSSVHCSLDLYKYKLIRGLLENNLGEPIEEFMRPYDLQDPRIHTVLSGEVYTCMCFLIDMVNVSLELKDPKRKEGAGSLARFDFKKCKLLYESFSNQTKSINLVSHSMMAFDTRYAGQKTSPGMTNVFSCIFQPAKNSSTTQGSIQIELHFRSTKDSSCFTVVLNNLRVFLIFDWLLLVHDFLHTPSDIKKQNHVTPSRHRNSSSESAIVPKTVKSGVVTKRSSLPVSNERHLEVKVNVTGTEFVVIEDVSCFDTNAIILKGTTVLTYKPRFVDRPFSGSLFGIEVFSCRLGNEHDTALSIVDPVQIQMELVGNSSYQNSSGLMDAFNSEDFPPVLEIQLQALDIRLSYNDVQLFLAIAKSIPEQANAAVPDSVALESDSVGTYLPGASRVGEEIREGTRHTLDPVLELQLARLQELGFSMDDCRKALLACQGQLKKAASWLFKNAEPLKSLSLASTSRDSPGAVAAPLISGVEIKAESVCICFIDDCMDCDVPLAELTFSRLNFLQRVRTSPEGYAHFTLSGDYYNRALSGWEPFIEPWPCSVSWQQQAAGRLHPPRLKLEAKAKPRLDINITSVLIDQYVSTKESWMADYCKDDKDIESAKSEDWMGSSVDPPCFGQSKSFHYMCLTKSLLTYKAMLH

SEQ ID NO: 848821 - protein, 130 aa, Homo sapiens [sequence omitted]

SEQ ID NO: 848822 - protein, 71 aa, Homo sapiens
FDFKKCKLLYESFSNQTKSINLVSHSMMAFDTRYAGQKTSPGMTNVFSCIFQPAKNSSTTQGSIQIELHFR

SEQ ID NO: 848823 - protein, 101 aa, Homo sapiens
PCCGPGRAGCWAGSVPWHRLGGAGAGQGGHPPVGWEGQVLGRESRVLGREGTLAQAQPQVLGDPAAFFLEARTPLPRGTGAFFLLRLVGGQDMRGYVLSPV

SEQ ID NO: 848824 - protein, 1530 aa, Homo sapiens
RGPPAARSSSRTAPMAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGAFGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 848825 - protein, 1530 aa, Homo sapiens; identical to SEQ ID NO: 848824

SEQ ID NO: 848826 - protein, 1530 aa, Homo sapiens; identical to SEQ ID NO: 848824

SEQ ID NO: 848827 - protein, 1530 aa, Homo sapiens; identical to SEQ ID NO: 848824

SEQ ID NO: 848828 - protein, 429 aa, Homo sapiens [sequence omitted]

SEQ ID NO: 848829 - protein, 319 aa, Homo sapiens
MKLCIWSQQVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 848830 - protein, 276 aa, Homo sapiens [sequence omitted]

SEQ ID NO: 848831 - protein, 1530 aa, Homo sapiens; identical to SEQ ID NO: 848824

SEQ ID NO: 848832 - protein, 1535 aa, Homo sapiens
RGPPAARSSSRTAPMAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGAFGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLFIGCLLGNPYPYPPWD

SEQ ID NO: 848833 - protein, 1535 aa, Homo sapiens; identical to SEQ ID NO: 848832

SEQ ID NO: 848834 - protein, 540 aa, Homo sapiens
RGPPAARSSSRTAPMAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGAFGDSGSGLGDARELLREETGAALKPRLPAPPPVTTPPLAGGSSTEDSRSEEVEEQTTVASLGAQTLPGSDSVSTWDGSVRTPGGRVKEVRPPPCAPEPF

SEQ ID NO: 848835 - protein, 1530 aa, Homo sapiens; identical to SEQ ID NO: 848824

SEQ ID NO: 848836 - protein, 1355 aa, Homo sapiens
GCTAAEEAASRGADGPGESMAPRCPWPWPRRRRLLDVLAPLVLLLGVRAASAEPERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGAFGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 848837 - protein, 49 aa, Homo sapiens
MCCPLFEEQHVVLWSPGAEHVAHHQPLLQKLVQDTPLPLSQRWPPSTSV

SEQ ID NO: 848838 - protein, 935 aa, Homo sapiens
LLLHTQGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 848839 - protein, 698 aa, Homo sapiens
ERSWGNRTGDLRAGCGGNEKVEQMSPVSRLPGREGIAGPGPKGDRGSRGEEGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 848840 - protein, 1101 aa, Homo sapiens
RGPPAARSSSRTAPMAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGAFGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPVCIILKRNSTKDE

SEQ ID NO: 848841 - protein, 77 aa, Homo sapiens
GCTAAEEAASRGADGPGESMAPRCPWPWPRRRRLLDVLAPLVLLLGVRAASAEPAFRVEVWETRGEAAQSHPPRAEA

SEQ ID NO: 848842 - protein, 580 aa, Homo sapiens
ERAWRLRWTTRPVVEMSGRSKRESRGSTRGKRESESRGSSGRVKRERDREREPEAASSRGSPVRVKREFEPASAREAPASVVPFVRVKREREVDEDSEPEREVRAKNGRVDSEDRRSRHCPYLDTINRSVLDFDFEKLCSISLSHINAYACLVCGKYFQGRGLKSHAYIHSVQFSHHVFLNLHTLKFYCLPDNYEIIDSSLEDITYVLKPTFTKQQIANLDKQAKLSRAYDGTTYLPGIVGLNNIKANDYANAVLQALSNVPPLRNYFLEEDNYKNIKRPPGDIMFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLPAEEKEQLLHNDEYQETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITNVDLREYLSEEVQAVHKNTTYDLIANIVHDGKPSEGSYRIHVLHHGTGKWYELQDLQVTDILPQMITLSEAYIQIWKRRDNDETNQQGA

SEQ ID NO: 848843 - protein, 503 aa, Homo sapiens
ERAWRLRWTTRPVVEMSGRSKRESRGSTRGKRESESRGSSGRVKRERDREREPEAASSRGSPVRVKREFEPASAREAPASVVPFVRVKREREVDEDSEPEREVRAKNGRVDSEDRRSRHCPYLDTINRSVLDFDFEKLCSISLSHINAYACLVCGKYFQGRGLKSHAYIHSVQFSHHVFLNLHTLKFYCLPDNYEIIDSSLEDITYVLKPTFTKQQIANLDKQAKLSRAYDGTTYLPGIVGLNNIKANDYANAVLQALSNVPPLRNYFLEEDNYKNIKRPPGDIMFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLPAEEKEQLLHNDEYQETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITGQANGMNYKTSR

SEQ ID NO: 848844 - protein, 580 aa, Homo sapiens; identical to SEQ ID NO: 848842

SEQ ID NO: 848845 - protein, 526 aa, Homo sapiens
GHSSSGTRVRLLSTFKPASAREAPASVVPFVRVKREREVDEDSEPEREVRAKNGRVDSEDRRSRHCPYLDTINRSVLDFDFEKLCSISLSHINAYACLVCGKYFQGRGLKSHAYIHSVQFSHHVFLNLHTLKFYCLPDNYEIIDSSLEDITYVLKPTFTKQQIANLDKQAKLSRAYDGTTYLPGIVGLNNIKANDYANAVLQALSNVPPLRNYFLEEDNYKNIKRPPGDIMFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLPAEEKEQLLHNDEYQETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITNVDLREYLSEEVQAVHKNTTYDLIANIVHDGKPSEGSYRIHVLHHGTGKWYELQDLQVTDILPQMITLSEAYIQIWKRRDNDETNQQGA

SEQ ID NO: 848846 - protein, 587 aa, Homo sapiens
ERAWRLRWTTRPVVEMSGRSKRESRGSTRGKRESESRGSSGRVKRERDREREPEAASSRGSPVRVKREFEPASAREAPASVVPFVRVKREREVDEDSEPEREVRAKNGRVDSEDRRSRHCPYLDTINRSVLDFDFEKLCSISLSHINAYACLVCGKYFQAFHPSLTGRGLKSHAYIHSVQFSHHVFLNLHTLKFYCLPDNYEIIDSSLEDITYVLKPTFTKQQIANLDKQAKLSRAYDGTTYLPGIVGLNNIKANDYANAVLQALSNVPPLRNYFLEEDNYKNIKRPPGDIMFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLPAEEKEQLLHNDEYQETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITNVDLREYLSEEVQAVHKNTTYDLIANIVHDGKPSEGSYRIHVLHHGTGKWYELQDLQVTDILPQMITLSEAYIQIWKRRDNDETNQQGA

SEQ ID NO: 848847 - protein, 296 aa, Homo sapiens
MFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLPAEEKEQLLHNDEYQETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITNVDLREYLSEEVQAVHKNTTYDLIANIVHDGKPSEGSYRIHVLHHGTGKWYELQDLQVTDILPQMITLSEAYIQIWKRRDNDETNQQGA

SEQ ID NO: 848848 - protein, 296 aa, Homo sapiens; identical to SEQ ID NO: 848847

SEQ ID NO: 848849 - protein, 488 aa, Homo sapiens
MESPELVTNTNEKEARGYYVSGGDTINSALEHGGWRSVLDFDFEKLCSISLSHINAYACLVCGKYFQGRGLKSHAYIHSVQFSHHVFLNLHTLKFYCLPDNYEIIDSSLEDITYVLKPTFTKQQIANLDKQAKLSRAYDGTTYLPGIVGLNNIKANDYANAVLQALSNVPPLRNYFLEEDNYKNIKRPPGDIMFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLPAEEKEQLLHNDEYQETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITNVDLREYLSEEVQAVHKNTTYDLIANIVHDGKPSEGSYRIHVLHHGTGKWYELQDLQVTDILPQMITLSEAYIQIWKRRDNDETNQQGA

SEQ ID NO: 848850 - protein, 580 aa, Homo sapiens; identical to SEQ ID NO: 848842

SEQ ID NO: 848851 - protein, 455 aa, Homo sapiens
MRTRSLSGRCEQRMAEWILRTGGAATARTWTPLTGRGLKSHAYIHSVQFSHHVFLNLHTLKFYCLPDNYEIIDSSLEDITYVLKPTFTKQQIANLDKQAKLSRAYDGTTYLPGIVGLNNIKANDYANAVLQALSNVPPLRNYFLEEDNYKNIKRPPGDIMFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLPAEEKEQLLHNDEYQETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITNVDLREYLSEEVQAVHKNTTYDLIANIVHDGKPSEGSYRIHVLHHGTGKWYELQDLQVTDILPQMITLSEAYIQIWKRRDNDETNQQGA

SEQ ID NO: 848852 - protein, 551 aa, Homo sapiens
ERAWRLRWTTRPVVEMSGRSKRESRGSTRGKRESESRGSSGRVKRERDREREPEAASSRGSPVRVKREFEPASAREAPASVVPFVRVKREREVDEDSEPEREVRAKNGRVDSEDRRSRHCPYLDTINRSVLDFDFEKLCSISLSHINAYACLVCGKYFQGRGLKSHAYIHSVQFSHHVFLNLHTLKFYCLPDNYEIIDSSLEDITYVLKPTFTKQQIANLDKQAKLSRAYDGTTYLPGIVGLNNIKANDYANAVLQALSNVPPLRNYFLEEDNYKNIKRPPGDIMFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLPAEEKEQLLHNDEYQETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITNVDLREYLSEEVQAVHKNTTYDLIANIVHDGKPSEGSYRIHVLHHIWKRRDNDETNQQGA

SEQ ID NO: 848853 - protein, 580 aa, Homo sapiens; identical to SEQ ID NO: 848842

SEQ ID NO: 848854 - protein, 571 aa, Homo sapiens
ERAWRLRWTTRPVVEMSGRSKRESRGSTRGKRESESRGSSGRVKRERDREREPEAASSRGSPVRVKREFEPASAREAPASVVPFVRVKREREVDEDSEPEREVRAKNGRVDSEDRRSRHCPYLDTINRSVLDFDFEKLCSISLSHINAYACLVCGKYFQGRGLKSHAYIHSVQFSHHVFLNLHTLKFYCLPDNYEIIDSSLEDITYVLKPTFTKQQIANLDKQAKLSRAYDGTTYLPGIVGLNNIKANDYANAVLQALSNVPPLRNYFLEEDNYKNIKRPPGDIMFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLPAEEKEQLLHNDEYQETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITNVDLREYLSEEVQAVHKNTTYDLIANIVHDGKPSEGSYRIHVLHHGTGKWYELQDLQVTDILPQMITLSEAYIQNLKHPK

SEQ ID NO: 848855 - protein, 470 aa, Homo sapiens
ERAWRLRWTTRPVVEMSGRSKRESRGSTRGKRESESRGSSGRVKRERDREREPEAASSRGSPVRVKREFEPASAREAPASVVPFVRVKREREVDEDSEPEREVRAKNGRVDSEDRRSRHCPYLDTINRSVLDFDFEKLCSISLSHINAYACLVCGKYFQGRGLKSHAYIHSVQFSHHVFLNLHTLKFYCLPDNYEIIDSSLEDITYVLKPTFTKQQIANLDKQAKLSRAYDGTTYLPGIVGLNNIKANDYANAVLQALSNVPPLRNYFLEEDNYKNIKRPPGDIMFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLAAEKRASAHNDEYRDMGGSLLCTGSDFYGPEREKRAYSSAFNWEAGPEGKTRGLEGHEQAPNWEGAKTGDPRAKGDRGNPQTPGRPQKAA

SEQ ID NO: 848856 - protein, 580 aa, Homo sapiens; identical to SEQ ID NO: 848842

SEQ ID NO: 848857 - protein, 580 aa, Homo sapiens; identical to SEQ ID NO: 848842

SEQ ID NO: 848858 - protein, 540 aa, Homo sapiens
ERAWRLRWTTRPVVEMSGRSKRESRGSTRGKRESESRGSSGRVKRERDREREPEAASSRGSPVRVKREFEPASAREAPASVVPFVRVKREREVDEDSEPEREVRAKNGRVDSEDRRSRHCPYLDTINRSVLDFDFEKLCSISLSHINAYACLVCGKYFQGRGLKSHAYIHSVQFSHHVFLNLHTLKFYCLPDNYEIIDSSLEDITYVLKPTFTKQQIANLDKQAKLSRAYDGTTYLPGIVGLNNIKANDYANAVLQALSNVPPLRNYFLEEDNYKNIKRPPGDIMFLLVQRFGELMRKLWNPRNFKAHVSPHEMLQAVVLCSKKTFQITKQGDGVDFLSWFLNALHSALGGTKKKKKTIVTDVFQGSMRIFTKKLPHPDLPAEEKEQLLHNDEYQETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITNVDLREYLSEEVQAVHKNTTYDLIANIVHDGKPSEGSYRIHVLHHVSGC

SEQ ID NO: 848859 - protein, 203 aa, Homo sapiens
RLKRHSGSRRDGCWQHDVETMVESTFMYLTLDLPTAPLYKDEKEQLIIPQVPLFNILAKFNGITEKEYKTYKENFLKRFQLTKLPPYLIFCIKRFTKNNFFVEKNPTIVNFPITNVDLREYLSEEVQAVHKNTTYDLIANIVHDGKPSEGSYRIHVLHHGTGKWYELQDLQVTDILPQMITLSEAYIQIWKRRDNDETNQQGA

SEQ ID NO: 848860 - protein, 1191 aa, Homo sapiens
MASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNRPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKTPDDHEAETGIKSKEARKYIFNCLDDMAQVNMTTDLEGSDMLVEKADRREFIDLLKKMLTIDADKRITPIETLNHPFVTMTHLLDFPHSTHVKSCFQNMEICKRRVNMYDTVNQSKTPFITHVAPSTSTNLTMTFNNQLTTVHNQAPSSTSATISLANPEVSILNYPSTLYQPSAASMAAVAQRSMPLQTGTAQICARPDPFQQALIVCPPGFQGLQASPSKHAGYSVRMENAVPIVTQAPGAQPLQIQPGLLAQQAWPSGTQQILLPPAWQQLTGVATHTSVQHATVIPETMAGTQQLADWRNTHAHGSHYNPIMQQPALLTGHVTLPAAQPLNVGVAHVMRQQPTSTTSSRKSKQHQSSVRNVSTCEVSSSQAISSPQRSKRVKENTPPRCAMVHSSPACSTSVTCGWGDVASSTTRERQRQTIVIPDTPSPTVSVITISSDTDEEEEQKHAPTSTVSKQRKNVISCVTVHDSPYSDSSSNTSPYSVQQRAGHNNANAFDTKGSLENHCTGNPRTIIVPPLKTQASEVLVECDSLVPVNTSHHSSSYKSKSSSNVTSTSGHSSGSSSGAITYRQQRPGPHFQQQQPLNLSQAQQHITTDRTGSHRRQQAYITPTMAQAPYSFPHNSPSHGTVHPHLAAAAAAAHLPTQPHLYTYTAPAALGSTGTVAHLVASQGSARHTVQHTAYPASIVHQVPVSMGPRVLPSPTIHPSQYPAQFAHQTYISASPASTVYTGYPLSPAKVNQYPYI

SEQ ID NO: 848861 - protein, 1164 aa, Homo sapiens
MASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNRPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKTPDDHEAETGIKSKEARKYIFNCLDDMAQVNMTTDLEGSDMLVEKADRREFIDLLKKMLTIDADKRITPIETLNHPFVTMTHLLDFPHSTHVKSCFQNMEICKRRVNMYDTVNQSKTPFITHVAPSTSTNLTMTFNNQLTTVHNQPSAASMAAVAQRSMPLQTGTAQICARPDPFQQALIVCPPGFQGLQASPSKHAGYSVRMENAVPIVTQAPGAQPLQIQPGLLAQQAWPSGTQQILLPPAWQQLTGVATHTSVQHATVIPETMAGTQQLADWRNTHAHGSHYNPIMQQPALLTGHVTLPAAQPLNVGVAHVMRQQPTSTTSSRKSKQHQSSVRNVSTCEVSSSQAISSPQRSKRVKENTPPRCAMVHSSPACSTSVTCGWGDVASSTTRERQRQTIVIPDTPSPTVSVITISSDTDEEEEQKHAPTSTVSKQRKNVISCVTVHDSPYSDSSSNTSPYSVQQRAGHNNANAFDTKGSLENHCTGNPRTIIVPPLKTQASEVLVECDSLVPVNTSHHSSSYKSKSSSNVTSTSGHSSGSSSGAITYRQQRPGPHFQQQQPLNLSQAQQHITTDRTGSHRRQQAYITPTMAQAPYSFPHNSPSHGTVHPHLAAAAAAAHLPTQPHLYTYTAPAALGSTGTVAHLVASQGSARHTVQHTAYPASIVHQVPVSMGPRVLPSPTIHPSQYPAQFAHQTYISASPASTVYTGYPLSPAKVNQYPYI

SEQ ID NO: 848862 - protein, 367 aa, Homo sapiens
KGRLVLLGWRFQLRCIVGACSTSVTCGWGDVASSTTRERQRQTIVIPDTPSPTVSVITISSDTDEEEEQKHAPTSTVSKQRKNVISCVTVHDSPYSDSSSNTSPYSVQQRAGHNNANAFDTKGSLENHCTGNPRTIIVPPLKTQASEVLVECDSLVPVNTSHHSSSYKSKSSSNVTSTSGHSSGSSSGAITYRQQRPGPHFQQQQPLNLSQAQQHITTDRTGSHRRQQAYITPTMAQAPYSFPHNSPSHGTVHPHLAAAAAAAHLPTQPHLYTYTAPAALGSTGTVAHLVASQGSARHTVQHTAYPASIVHQVPVSMGPRVLPSPTIHPSQYPAQFAHQTYISASPASTVYTGYPLSPAKVNQYPYI

SEQ ID NO: 848863 - protein, 313 aa, Homo sapiens
RSWDPSHVGRTGGGQKHAPTSTVSKQRKNVISCVTVHDSPYSDSSSNTSPYSVQQRAGHNNANAFDTKGSLENHCTGNPRTIIVPPLKTQASEVLVECDSLVPVNTSHHSSSYKSKSSSNVTSTSGHSSGSSSGAITYRQQRPGPHFQQQQPLNLSQAQQHITTDRTGSHRRQQAYITPTMAQAPYSFPHNSPSHGTVHPHLAAAAAAAHLPTQPHLYTYTAPAALGSTGTVAHLVASQGSARHTVQHTAYPASIVHQVPVSMGPRVLPSPTIHPSQYPAQFAHQTYISASPASTVYTGYPLSPAKVNQYPYI

SEQ ID NO: 848864 - protein, 983 aa, Homo sapiens
MAPVYEGMASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNRPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKTPDDHEAETGIKSKEARKYIFNCLDDMAQVNMTTDLEGSDMLVEKADRREFIDLLKKMLTIDADKRITPIETLNHPFVTMTHLLDFPHSTHVKSCFQNMEICKRRVNMYDTVNQSKTPFITHVAPSTSTNLTMTFNNQLTTVHNQPSAASMAAVAQRSMPLQTGTAQICARPDPFQQALIVCPPGFQGLQASPSKHAGYSVRMENAVPIVTQAPGAQPLQIQPGLLAQQAWPSGTQQILLPPAWQQLTGVATHTSVQHATVIPETMAGTQQLADWRNTHAHGSHYNPIMQQPALLTGHVTLPAAQPLNVGVAHVMRQQPTSTTSSRKSKQHQSSVRNVSTCEVSSSQAISSPQRSKRVKENTPPRCAMVHSSPACSTSVTCGWGDVASSTTRERQRQTIVIPDTPSPTVSVITISSDTDEEEEQKHAPTSTVSKQRKNVISCVTVHDSPYSDSSSNTSPYSVQQRAGHNNANAFDTKGSLENHCTGNPRTIIVPPLKTQASEVLVECDSLVPVIWGQDRAGTSPWRVVFLLFCC

SEQ ID NO: 848865 - protein, 866 aa, Homo sapiens
MAPVYEGMASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNRPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKTPDDHEAETGIKSKEARKYIFNCLDDMAQVNMTTDLEGSDMLVEKADRREFIDLLKKMLTIDADKRITPIETLNHPFVTMTHLLDFPHSTHVKSCFQNMEICKRRVNMYDTVNQSKTPFITHVAPSTSTNLTMTFNNQLTTVHNQPSAASMAAVAQRSMPLQTGTAQICARPDPFQQALIVCPPGFQGLQASPSKHAGYSVRMENAVPIVTQAPGAQPLQIQPGLLAQQAWPSGTQQILLPPAWQQLTGVATHTSVQHATVIPETMAGTQQLADWRNTHAHGSHYNPIMQQPALLTGHVTLPAAQPLNVGVAHVMRQQPTSTTSSRKSKQHQSSVRNVSTCEVSSSQAISSPQRSKRVKENTPPRCAMVHSSPACSTSVTCGWGDVASSTTRERQRQTIVIPDTPSPTVNLSGVGIL

SEQ ID NO: 848866 - protein, 697 aa, Homo sapiens
MAPVYEGMASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNRPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKTPDDHEAETGIKSKEARKYIFNCLDDMAQVNMTTDLEGSDMLVEKADRREFIDLLKKMLTIDADKRITPIETLNHPFVTMTHLLDFPHSTHVKSCFQNMEICKRRVNMYDTVNQSKTPFITHVAPSTSTNLTMTFNNQLTTVHNQPSAASMAAVAQRSMPLQTGTAQICARPDPFQQALIVCPPGFQGLQASPSKHAGYSVRMENAVPIVTQAPGAQPLQIQPGLLAQQAWPKKPLRGSSKIRPQASQ

SEQ ID NO: 848867 - protein, 651 aa, Homo sapiens
MASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNRPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKTPDDHEAETGIKSKEARKYIFNCLDDMAQVNMTTDLEGSDMLVEKADRREFIDLLKKMLTIDADKRITPIETLNHPFVTMTHLLDFPHSTHVKSCFQNMEICKRRVNMYDTVNQSKTPFITHVAPSTSTNLTMTFNNQLTTVHNQPSAASMAAVAQRSMPLQTGTAQICARPDPFQQALIVCPPGFQGLQASPSPHSTHVKSCFQNMEI

SEQ ID NO: 848868 - protein, 627 aa, Homo sapiens
MAPVYEGMASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNRPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKTPDDHEAETGIKSKEARKYIFNCLDDMAQVNMTTDLEGSDMLVEKADRREFIDLLKKMLTIDADKRITPIETLNHPFVTMTHLLDFPHSTHVKSCFQNMEICKRRVNMYDTVNQSKTPFITHVAPSTSTNLTMTFNNQLTTVHNQVSGKQKGRRGGAAQCEPQDLYFPSYLVRRQNSC

SEQ ID NO: 848869 - protein, 562 aa, Homo sapiens
MAPVYEGMASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNRPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKTPDDHEAETGIKSKEARKYIFNCLDDMAQVNMTTDLEGSDMLVEKADRREFIDLLKKMLTIDADKRITPIETLNHPFVTMTHLLDFPHSTHVKSCFQNMEICKRRAALLRFDL

SEQ ID NO: 848870 - protein, 909 aa, Homo sapiens
MASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNRPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKTPDDHEAETGIKSKEARKYIFNCLDDMAQVNMTTDLEGSDMLVEKADRREFIDLLKKMLTIDADKRITPIETLNHPFVTMTHLLDFPHSTHVKSCFQNMEICKRRVNMYDTVNQSKTPFITHVAPSTSTNLTMTFNNQLTTVHNQAPSSTSATISLANPEVSILNYPSTLYQPSAASMAAVAQRSMPLQTGTAQICARPDPFQQALIVCPPGFQGLQASPSKHAGYSVRMENAVPIVTQAPGAQPLQIQPGLLAQQAWPSGTQQILLPPAWQQLTGVATHTSVQHATVIPETMAGTQQLADWRNTHAHGSHYNPIMQQPALLTGHVTLPAAQPLNVGVAHVMRQQPTSTTSSRKSKQHQSSVSTVSKQRKNVISCVTVHDSPYSDSSSNTSPYSVQQRAGHNNANAFDTKGSLENHCTGNPRTIIVPPLKTQASEVLVECDSLVPVIWGQDRAGTSPWRVVFLLFCC

SEQ ID NO: 848871 - protein, 696 aa, Homo sapiens
MAQVNMTTDLEGSDMLVEKADRREFIDLLKKMLTIDADKRITPIETLNHPFVTMTHLLDFPHSTHVKSCFQNMEICKRRVNMYDTVNQSKTPFITHVAPSTSTNLTMTFNNQLTTVHNQPSAASMAAVAQRSMPLQTGTAQICARPDPFQQALIVCPPGFQGLQASPSKHAGYSVRMENAVPIVTQAPGAQPLQIQPGLLAQQAWPSGTQQILLPPAWQQLTGVATHTSVQHATVIPETMAGTQQLADWRNTHAHGSHYNPIMQQPALLTGHVTLPAAQPLNVGVAHVMRQQPTSTTSSRKSKQHQSSVRNVSTCEVSSSQAISSPQRSKRVKENTPPRCAMVHSSPACSTSVTCGWGDVASSTTRERQRQTIVIPDTPSPTVSVITISSDTDEEEEQKHAPTSTVSKQRKNVISCVTVHDSPYSDSSSNTSPYSVQQRAGHNNANAFDTKGSLENHCTGNPRTIIVPPLKTQASEVLVECDSLVPVNTSHHSSSYKSKSSSNVTSTSGHSSGSSSGAITYRQQRPGPHFQQQQPLNLSQAQQHITTDRTGSHRRQQAYITPTMAQAPYSFPHNSPSHGTVHPHLAAAAAAAHLPTQPHLYTYTAPAALGSTGTVAHLVASQGSARHTVQHTAYPASIVHQVPVSMGPRVLPSPTIHPSQYPAQFAHQTYISASPASTVYTGYPLSPAKVNQYPYI

SEQ ID NO: 848872 - protein, 572 aa, Homo sapiens [sequence omitted]

SEQ ID NO: 848873 - protein, 254 aa, Homo sapiens
MRLICYCPASGTCFFLEDHCSLVGQHLLGSWDPATDLTSFSSRHINTSHHSSSYKSKSSSNVTSTSGHSSGSSSGAITYRQQRPGPHFQQQQPLNLSQAQQHITTDRTGSHRRQQAYITPTMAQAPYSFPHNSPSHGTVHPHLAAAAAAAHLPTQPHLYTYTAPAALGSTGTVAHLVASQGSARHTVQHTAYPASIVHQVPVSMGPRVLPSPTIHPSQYPAQFAHQTYISASPASTVYTGYPLSPAKVNQYPYI

SEQ ID NO: 848874 - protein, 237 aa, Homo sapiens
SRGPVTQLMTVFSLLGDSAGGGVIAWCLNTSHHSSSYKSKSSSNVTSTSGHSSGSSSGAITYRQQRPGPHFQQQQPLNLSQAQQHITTDRTGSHRRQQAYITPTMAQAPYSFPHNSPSHGTVHPHLAAAAAAAHLPTQPHLYTYTAPAALGSTGTVAHLVASQGSARHTVQHTAYPASIVHQVPVSMGPRVLPSPTIHPSQYPAQFAHQTYISASPASTVYTGYPLSPAKVNQYPYI

SEQ ID NO: 848875 - protein, 945 aa, Homo sapiens
MAPVYEGMASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNRPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKTPDDHEAETGIKSKEARKYIFNCLDDMAQVNMTTDLEGSDMLVEKADRREFIDLLKKMLTIDADKRITPIETLNHPFVTMTHLLDFPHSTHVKSCFQNMEICKRRVNMYDTVNQSKTPFITHVAPSTSTNLTMTFNNQLTTVHNQPSAASMAAVAQRSMPLQTGTAQICARPDPFQQALIVCPPGFQGLQASPSKHAGYSVRMENAVPIVTQAPGAQPLQIQPGLLAQQAWPSGTQQILLPPAWQQLTGVATHTSVQHATVIPETMAGTQQLADWRNTHAHGSHYNPIMQQPALLTGHVTLPAAQPLNVGVAHVMRQQPTSTTSSRKSKQHQSSVRNVSTCEVSSSQAISSPQRSKRVKENTPPRCAMVHSSPACSTSVTCGWGDVASSTTRERQRQTIVIPDTPSPTVSVITISSDTDEEEEQKHAPTSTVSKQRKNVISCVTVHDSPYSDSSSNTSPYSVQQRAGHNNANAFDTKGSLENHCTGNPRTIIVPPL

SEQ ID NO: 848876 - protein, 476 aa, Homo sapiens
MAPVYEGMASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNRPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKVGRASPPLLTVAQRLGKRAVDPLVGSF

SEQ ID NO: 848877 - protein, 369 aa, Homo sapiens
PHPFSRPSYPQLLALGGANCSAEISAAKLRLPPRAVPRGSPEAWANQRTSSSSGISVEDPTLVPHAPVEITSIGIDSRQSALHRAHAVTGMKSVATHIIHITGTAGLLRHIGRVGHIDPALAFTRRPPWVSPLQQGAGKTEGTESTLERPRLVSDHPLAIASPPQRPNWINAQCLNITEEATGVIAYAHTYPQPSMSGLQHTNSETQSRPNHGEPITGAANRGGYTNSQTTRVRNTEVPLPQHVTLNPVTTCSRTHKLAPKVRNRQYYMEALSWAPQGNLGLKPRRNPQTIKPITVEKTKSHTIVSSPERTDNHVTYYYHRSQTEHPVRTAAHTFGLTGPIHFAQAGNQASLYFIEYDTDLERFRKHVD

SEQ ID NO: 848878 - protein, 432 aa, Homo sapiens
MSELKDCPLQFHDFKSVDHLKVCPRYTAVLARSEDDGIGIEELDTLQLELETLLSSASRRLRVLEAETQILTDWQDKKGDRRFLKLGRDHELGAPPKHGKPKKQKLEGKAGHGPGPGPGRPKSKNLQPKIQEYEFTDDPIDVPRIPKNDAPNRFWASVEPYCADITSEEVRTLEELLKPPEDEAEHYKIPPLGKHYSQRWAQEDLLEEQKDGARAAAVADKKKGLMGPLTELDTKDVDALLKKSEAQHEQPEDGCPFGALTQRLLQALVEENIISPMEDSPIPDMSGKESGADGASTSPRNQNKPFSVPHTKSLESRIKEELIAQGLLESEDRPAEDSEDEVLAELRKRQAELKALSAHNRTKKHDLLRLAKEEVSRQELRQRVRMADNEVMDAFRKIMAARQKKRTPTKKEKDQAWKTLKERESILKLLDG

SEQ ID NO: 848879 - protein, 432 aa, Homo sapiens; identical to SEQ ID NO: 848878

SEQ ID NO: 848880 - protein, 373 aa, Homo sapiens
MSELKDCPLQFHDFKSVDHLKVCPRYTAVLARSEDDGIGIEELDTLQLELETLLSSASRRLRVLEAETQILTDWQDKKGDRRFLKLGRDHELGAPPKHGKPKKQKLEGKAGHGPGPGPGRPKSKNLQPKIQEYEFTDDPIDVPRIPKNDAPNRFWASVEPYCADITSEEVRTLEELLKPPEDEAEHYKHEQPEDGCPFGALTQRLLQALVEENIISPMEDSPIPDMSGKESGADGASTSPRNQNKPFSVPHTKSLESRIKEELIAQGLLESEDRPAEDSEDEVLAELRKRQAELKALSAHNRTKKHDLLRLAKEEVSRQELRQRVRMADNEVMDAFRKIMAARQKKRTPTKKEKDQAWKTLKERESILKLLDG

SEQ ID NO: 848881 - protein, 285 aa, Homo sapiens [sequence omitted]

SEQ ID NO: 848882 - protein, 207 aa, Homo sapiens
MGPLTELDTKDVDALLKKSEAQHEQPEDGCPFGALTQRLLQALVEENIISPMEDSPIPDMSGKESGADGASTSPRNQNKPFSVPHTKSLESRIKEELIAQGLLESEDRPAEDSEDEVLAELRKRQAELKALSAHNRTKKHDLLRLAKEEVSRQELRQRVRMADNEVMDAFRKIMAARQKKRTPTKKEKDQAWKTLKERESILKLLDG

SEQ ID NO: 848883 - protein, 291 aa, Homo sapiens
MAGQCLPTQGWVPSFPQIPPLGKHYSQRWAQEDLLEEQKDGARAAAVADKKKGLMGPLTELDTKGRPLTSLPTPGQDLNSRTSAHLPLLSCARLDVDALLKKSEAQHEQPEDGCPFGALTQRLLQALVEENIISPMEDSPIPDMSGKESGADGASTSPRNQNKPFSVPHTKSLESRIKEELIAQGLLESEDRPAEDSEDEVLAELRKRQAELKALSAHNRTKKHDLLRLAKEEVSRQELRQRVRMADNEVMDAFRKIMAARQKKRTPTKKEKDQAWKTLKERESILKLLDG

SEQ ID NO: 848884 - protein, 209 aa, Homo sapiens
MSELKDCPLQFHDFKSVDHLKVCPRYTAVLARSEDDGIGIEELDTLQLELETLLSSASRRLRVLEAETQILTDWQDKKGDRRFLKLGRDHELGAPPKHGKPKKQKLEGKAGHGPGPGPGRPKSKNLQPKIQEYEFTDDPIDVPRIPKNDAPNRFWAREHRRGPQGSGGGGTGGAGAPTQDLLLPAGSGLQWSPTVLTSPARRSAHLRSY

SEQ ID NO: 848885 - protein, 129 aa, Homo sapiens
PHPFSRPSYPQLLALGGANCSAEISAAKLRLPPRAVPRGSPEADHPHPTSSGFARGPPSSHPRQTPVGSPSLTPRPRVNCKGPAHSQFRGGCSHRPELHLNHLHAGHLRDLQSDCQTRKVDEGAGESRN

SEQ ID NO: 848886 - protein, 128 aa, Homo sapiens
IVDTYVACFKNQTRCVCPSLCIWIDTEGVPKGKGRFSLTLGSPGNLQGGPFSKLALESDGPASRCSVPHTKSLESRIKEELIAQGLLESEDRPAEDSEDEVLAELRKRQAELKALSAHNRTKKHDLLR

SEQ ID NO: 848887 - protein, 369 aa, Homo sapiens
MSELKDCPLQFHDFKSVDHLKVCPRYTAVLARSEDDGIGIEELDTLQLELETLLSSASRRLRVLEAETQILTDWQDKKGDRRFLKLGRDHELGAPPKHGKPKKQKLEGKAGHGPGPGPGRPKSKNLQPKIQEYEFTDDPIDVPRIPKNDAPNRFWASVEPYCADITSEEVRTLEELLKPPEDEAEHYKIPPLGKHYSQRWAQEDLLEEQKDGARAAAVADKKKGLMGPLTELDTKDVDALLKKSEAQHEQPEDGCPFGALTQRLLQALVEENIISPMEDSPIPDMSGKESGADGASTSPRNQNKPFSVPHTKSLESRIKEELIAQGLLESEDRPAEDSEDEVLAELRKRQAELKALSAHNRTKKHDLLR

SEQ ID NO: 848888 - protein, 432 aa, Homo sapiens; identical to SEQ ID NO: 848878

SEQ ID NO: 848889 - protein, 434 aa, Homo sapiens
MSELKDCPLQFHDFKSVDHLKVCPRYTAVLARSEDDGIGIEELDTLQLELETLLSSASRRLRVLEAETQILTDWQDKKGDRRFLKLGRDHELGAPPKHGKPKKQKLEGKAGHGPGPGPGRPKSKNLQPKIQEYEFTDDPIDVPRIPKNDAPNRFWASVEPYCADITSEEVRTLEELLKPPEDEAEHYKYKIPPLGKHYSQRWAQEDLLEEQKDGARAAAVADKKKGLMGPLTELDTKDVDALLKKSEAQHEQPEDGCPFGALTQRLLQALVEENIISPMEDSPIPDMSGKESGADGASTSPRNQNKPFSVPHTKSLESRIKEELIAQGLLESEDRPAEDSEDEVLAELRKRQAELKALSAHNRTKKHDLLRLAKEEVSRQELRQRVRMADNEVMDAFRKIMAARQKKRTPTKKEKDQAWKTLKERESILKLLDG

SEQ ID NO: 848890 - protein, 467 aa, Homo sapiens
MSELKDCPLQFHDFKSVDHLKVCPRYTAVLARSEDDGIGIEELDTLQLELETLLSSASRRLRVLEAETQILTDWQDKKGDRRFLKLGRDHELGAPPKHGKPKKQKLEGKAGHGPGPGPGRPKSKNLQPKIQEYEFTDDPIDVPRIPKNDAPNRFWAREHRRGPQGSGGGGTGGAGAPTQDLLLPCRFWASVEPYCADITSEEVRTLEELLKPPEDEAEHYKYKIPPLGKHYSQRWAQEDLLEEQKDGARAAAVADKKKGLMGPLTELDTKDVDALLKKSEAQHEQPEDGCPFGALTQRLLQALVEENIISPMEDSPIPDMSGKESGADGASTSPRNQNKPFSVPHTKSLESRIKEELIAQGLLESEDRPAEDSEDEVLAELRKRQAELKALSAHNRTKKHDLLRLAKEEVSRQELRQRVRMADNEVMDAFRKIMAARQKKRTPTKKEKDQAWKTLKERESILKLLDG

SEQ ID NO: 848891 - protein, 264 aa, Homo sapiens [sequence omitted]

SEQ ID NO: 848892 - protein, 196 aa, Homo sapiens
MSELKDCPLQFHDFKSVDHLKVCPRYTAVLARSEDDGIGIEELDTLQLELETLLSSASRRLRVLEAETQILTDWQDKKGDRRFLKLGRDHELGAPPKHGKPKKQKLEGKAGHGPGPGPGRPKSKNLQPKIQEYEFTDDPIDVPRIPKNDAPNRFWASVEPYCADITSEEVRTLEELLKPPEDEAEHYKLQGRNSGP

SEQ ID NO: 848893 - protein, 640 aa, Homo sapiens
GVLEDPVVSGDGPFAGGEVDKRLHQLKTQLATLTSSLATVTQEKSRMEASYLADKKKMKQDLEDASNKAEEERARLEGELKGLQEQIAETKARLITQQHDRAQEQSDHALMLRELQKLLQEERTQRQDLELRLEETREALAGRAYAAEQMEGFELQTKQLTREVEELKSELQAIRDEKNQPDPRLQELQEEAARLKSHFQAQLQQEMRKTALAEDQLRQQSQVEEQRVAALENQISEVSELLGTYEKAKQKDQLAIQKLKERILQLDLENKTLALAASSRSPLDSHGEESSLDVNVLKDKMEKLKRLLQVAARKSQVTLDVEKLCDLEIMPSSEAADGEKATALYYQQELKQLKEEFERYKMRAQVVLKSKNTKDGNLGKELEAAQEQLAELKEKYISLRLSCEELEHQHQQEADDWKQELARLQQLHRQELERCQLDFRDRTLKLEEELHKQRDRALAVLTEKDLELEQLRSVALASGLPGRRSPVGGGGPGDPADTSSSDSLTQALQLAAANEPTFFLYAEQLARKEVEITSLRKQKHRLEVEVHQLQDRLLEEGERHREEVAALQSHIEKNIRDQSREGANLEYLKNIIYRFLTLPDSLGRQQTLTAILTILHFSPEEKQVIMRLPTSASWWPSGKR

SEQ ID NO: 848894 - protein, 775 aa, Homo sapiens
MEKFGMNFGGGPSKKDLLETIETQKKQLLQYQARLKDVVRAYKSLLKEKEALEASIKVLSVSHEADVGLAGVQLPGLTFPDSVDDRCSTHSEDSTGTATSLDTAASLTSTKGEFGVEDDRPARGPPPPKSEEASWSESGVSSSSGDGPFAGGEVDKRLHQLKTQLATLTSSLATVTQEKSRMEASYLADKKKMKQDLEDASNKAEEERARLEGELKGLQEQIAETKARLITQQHDRAQEQSDHALMLRELQKLLQEERTQRQDLELRLEETREALAGRAYAAEQMEGFELQTKQLTREVEELKSELQAIRDEKNQPDPRLQELQEEAARLKSHFQAQLQQEMRKTALAEDQLRQQSQVEEQRVAALENQISEVSELLGTYEKAKQKDQLAIQKLKERILQLDLENKTLALAASSRSPLDSHGEESSLDVNVLKDKMEKLKRLLQVAARKSQVTLDVEKLCDLEIMPSSEAADGEKATALYYQQELKQLKEEFERYKMRAQVVLKSKNTKDGNLGKELEAAQEQLAELKEKYISLRLSCEELEHQHQQEADDWKQELARLQQLHRQELERCQLDFRDRTLKLEEELHKQRDRALAVLTEKDLELEQLRSVALASGLPGRRSPVGGGGPGDPADTSSSDSLTQALQLAAANEPTFFLYAEQLARKEVEITSLRKQKHRLEVEVHQLQDRLLEEGERHREEVAALQSHIEKNIRDQSREGANLEYLKNIIYRFLTLPDSLGRQQTLTAILTILHFSPEEKQVIMRLPTSASWWPSGKR

SEQ ID NO: 848895 - protein, 775 aa, Homo sapiens; identical to SEQ ID NO: 848894

SEQ ID NO: 848896 - protein, 464 aa, Homo sapiens
MCKEIKTCYEGYNQAAWSQNPASKEKSKLGKTKTALAEDQLRQQSQVEEQRVAALENQISEVSELLGTYEKAKQKDQLAIQKLKERILQLDLENKTLALAASSRSPLDSHGEESSLDVNVLKDKMEKLKRLLQVAARKSQVTLDVEKLCDLEIMPSSEAADGEKATALYYQQELKQLKEEFERYKMRAQVVLKSKNTKDGNLGKELEAAQEQLAELKEKYISLRLSCEELEHQHQQEADDWKQELARLQQLHRQELERCQLDFRDRTLKLEEELHKQRDRALAVLTEKDLELEQLRSVALASGLPGRRSPVGGGGPGDPADTSSSDSLTQALQLAAANEPTFFLYAEQLARKEVEITSLRKQKHRLEVEVHQLQDRLLEEGERHREEVAALQSHIEKNIRDQSREGANLEYLKNIIYRFLTLPDSLGRQQTLTAILTILHFSPEEKQVIMRLPTSASWWPSGKR

SEQ ID NO: 848897 - protein, 775 aa, Homo sapiens; identical to SEQ ID NO: 848894

SEQ ID NO: 848898 - protein, 108 aa, Homo sapiens
AGFNIIVTSLTVLVSYTFILSSILGISTTEGRSKAFSTCSSHLAAVGMFYGSTAFMYLKPSTISSLTQENVASVFYTTVIPMLNPLIYSLRNKEVKAAVQKTLRGKLF

SEQ ID NO: 848899 - protein, 184 aa, Homo sapiens
AGFNIIVTSLTVLVSYTFILSSILGISTTEGRSKAFSTCSSHLAAVGMFYGSTAFMYLKPSTISSLTQENVASVFYTTVIPMLNPLIYSLRNKEVKAAVQKTLRGCLCTAMLIRILLLVHMAADPMISEALLANKMGKFIAVGLPLLLMSLAQEFSSVLLPLPGAAGVDYTTLFLSLHGIWSKT

SEQ ID NO: 848900 - protein, 192 aa, Homo sapiens
KAHTVPTWPKSTVPLGGPLSPACNQTIPAGWKSQLHKWFDSHIPRWACTPPGYVFLCGPQKNKLPFDGSPKITYSTPPVANLYTCINNIQHTGECAVGLLGPRGIGVTIYNTTQPRQKRALGLILAGMGAAIGMIAPWGGFTYHDVTLRNLSRQIDNIAKSTRDSISKLKASIDSLANVVMNNRLALDYLLA

SEQ ID NO: 848901 - protein, 169 aa, Homo sapiens
ERGGAGFPWVRAQLSVRQFTLRVRVPGPVHLRGRSPTPALDPLAPLNPLIRGPRTPGLRRTEPRLTRSCRGAFRSPRPLPKSGQADGTSEESLHLDIQKLKEKRDMLDKEISQFVSEGYSVDELEDHITQLHEYNDIKDVGQMLMGKLAVIRGVTTKELYPEFGLDMND

SEQ ID NO: 848902 - protein, 265 aa, Homo sapiens
MATLLRPVLRRLCGLPGLQRPAAEMPLRARSDGAGPLYSHHLPTSPLQKALLAAGSAAMALYNPYRHDMVAVLGETTGHRTLKVLRDQMRRDPEGAQILQERPRISTSTLDLGKLQSLPEGSLGREYLRFLDVNRVSPDTRAPTRFVDDEELAYVIQRYREVHDMLHTLLGMPTNILGEIVVKWFEAVQTGLPMCILGAFFGPIRLGAQSLQVLVSELIPWAVQNGRRAPCVLNLYYERRWEQSLRALREELGITAPPMHVQGLA

SEQ ID NO: 848903 - protein, 169 aa, Homo sapiens; identical to SEQ ID NO: 848901

SEQ ID NO: 848904 - protein, 150 aa, Homo sapiens
ERGGAGFPWVRAQLSVRQFTLRVRVPGPVHLRGRSPTPALDPLAPLNPLIRGPRTPGLRRTEPRLTRSCRGAFRSPRPLPKSGQADGTSEESLHLDIQKLKEKRDMLDKEISQFVSEGYSVDELEDHITQLHEYNDIKDVGQMLMGKLGE

SEQ ID NO: 848905 - protein, 241 aa, Homo sapiens [sequence omitted]

SEQ ID NO: 848906 - protein, 241 aa, Homo sapiens [sequence omitted]

SEQ ID NO: 848907 - protein, 183 aa, Homo sapiens
MATLLRPVLRRLCGLPGLQRPAAEMPLRARSDGAGPLYSHHLPTSPLQKALLAAGSAAMALYNPYRHDMVAVLGETTGHRTLKVLRDQMRRDPEGAQILQERPRISTSTLDLGKLQSLPEGSLGREYLRFLDVNRVSPDTRAPTRFVDDEELAYVIQRYREVHDMLHTLLGMPTNILGECPQP

SEQ ID NO: 848908 - protein, 162 aa, Homo sapiens
MVRVVTVSETDWQIGPWEPSGRVLGEAHGCQRVSPDTRAPTRFVDDEELAYVIQRYREVHDMLHTLLGMPTNILGEIVVKWFEAVQTGLPMCILGAFFGPIRLGAQSLQVLVSELIPWAVQNGRRAPCVLNLYYERRWEQSLRALREELGITAPPMHVQGLA

SEQ ID NO: 848909 - protein, 183 aa, Homo sapiens; identical to SEQ ID NO: 848907

SEQ ID NO: 848910 - protein, 178 aa, Homo sapiens
MATLLRPVLRRLCGLPGLQRPAAEMPLRARSDGAGPLYSHHLPTSPLQKALLAAGSAAMALYNPYRHDMVAVLGETTGHRTLKVLRDQMRRDPEGAQILQERPRISTSTLDLGKLQSLPEGSLGREYLRFLDVNRVSPDTRAPTRFVDDEELAYVIQRYREVHDMLHTPASLGGRGLP

SEQ ID NO: 848911 - protein, 209 aa, Homo sapiens
ERGGAGFPWVRAQLSVRQFTLRVRVPGPVHLRGRSPTPALDPLAPLNPLIRGPRTPGLRRWIQSLALLLPNCSSSRIPTVPRPHSGLWVQSDFPLGFLSRTEPRLTRSCRGAFRSPRPLPKSGQADGTSEESLHLDIQKLKEKRDMLDKEISQFVSEGYSVDELEDHITQLHEYNDIKDVGQMLMGKLAVIRGVTTKELYPEFGLDMND

SEQ ID NO: 848912 - protein, 260 aa, Homo sapiens
ERGGAGFPWVRAQLSVRQFTLRVRVPGPVHLRGRSPTPALDPLAPLNPLIRGPRTPGLRRWIQSLALLLPNCSSSRIPTVPRPHSGLWVQSDFPLGFLSRTEPRLTRSCRGAFRSPRPLPKSGQADGTSEESLHLDIQKLKEKRDMLDKEISQFVSEGYSVDELEDHITQLHEYNDIKDVGQMLMGKLAVIRGVTTKELYPEFGPDASTAFSSIAHITRDVNYGCIIRYLHANGASIFFICLFLHIGRGLYYGSFLYSET

SEQ ID NO: 848913 - protein, 169 aa, Homo sapiens; identical to SEQ ID NO: 848901

SEQ ID NO: 848914 - protein, 144 aa, Homo sapiens
SLETRDQRTPGGPVWGGRRTEPRLTRSCRGAFRSPFLPATFEKTLYCPHVERPLPKSGQADGTSEESLHLDIQKLKEKRDMLDKEISQFVSEGYSVDELEDHITQLHEYNDIKDVGQMLMGKLAVIRGVTTKELYPEFGLDMND

SEQ ID NO: 848915 - protein, 157 aa, Homo sapiens
ERGGAGFPWVRAQLSVRQFTLRVRVPGPVHLRGRSPTPALDPLAPLNPLIRGPRTPGLRRTEPRLTRSCRGAFRSPRPLPKSGQADGTSEESLHLDIQKLKEKRDMLDKEISQFVSEGYSVDELEDHITQLHEYNDIKDVGQMLMGKLASRPHGSHL

SEQ ID NO: 848916 - protein, 265 aa, Homo sapiens; identical to SEQ ID NO: 848902

SEQ ID NO: 848917 - protein, 265 aa, Homo sapiens; identical to SEQ ID NO: 848902

SEQ ID NO: 848918 - protein, 247 aa, Homo sapiens
MRLSRRSRVRLQAAKMPRLGEGGRILAHSHLPVQKRCWRGRAMGSIPTQNMVAVLGETTGHRTLKVLRDQMRRDPEGAQILQERPRISTSTLDLGKLQSLPEGSLGREYLRFLDVNRVSPDTRAPTRFVDDEELAYVIQRYREVHDMLHTLLGMPTNILGEIVVKWFEAVQTGLPMCILGAFFGPIRLGAQSLQVLVSELIPWAVQNGRRAPCVLNLYYERRWEQSLRALREELGITAPPMHVQGLA

SEQ ID NO: 848919 - protein, 250 aa, Homo sapiens
MATLLRPVLRRLCGLPGLQRPAAEMPLRARSDGAGPLYSHHLPTSPLQKALLAAGSAAMALYNPYRHDMVAVLGETTGHRTLKVLRDQMRRDPEGAQILQERPRISTSTLDLGKLQSLPEGSLGREYLRFLDVNRVSPDTRAPTRFVDDEELAYVIQRYREVHDMLHTLLGMPTNILGEIVVKWFEAVQTGLPMCILGAFFGPIRLGAQSLQVLVSELIPWAVQNGRRAPCVLNLYYERRWEQSLRNRGP

SEQ ID NO: 848920 - protein, 115 aa, Homo sapiens
MATLLRPVLRRLCGLPGLQRPAAGKWRRVLGAGGKEPEGARLLCPRPFSCPAEMPLRARSDGAGPLYSHHLPTSPLQKALLAAGSAAMALYNPYRHGKAARASPPWGRLGAVSCG

SEQ ID NO: 848921 - protein, 46 aa, Homo sapiens
MSASFHCICSLLDSAWHIVQRLTSDAELCGETKRQADAAGDKPSMP

SEQ ID NO: 848922 - protein, 203 aa, Homo sapiens
MACGATLKRTLDFDPLLSPASPKRRRCAPLSAPTSAAASPLSAAAATAASFSAAAASPQKYLRMEPSPFGDVSSRLTTEQILYNIKQEYKRMQKRRHLETSFQQTDPCCTSDAQPHAFLLSGPASPGTSSAASSPLKKEQPLFTLRQVGMICERLLKEREEKVREEYEEILNTKLAEQYDAFVKFTHDQIMRRYGEQPASYVS

SEQ ID NO: 848923 - protein, 217 aa, Homo sapiens
MACGATLKRTLDFDPLLSPASPKRRRCAPLSAPTSAAASPLSAAAATAASFSAAAASPQKYLRMEPSPFGDVSSRLTTEQILYNIKQEYKRMQKRRHLETSFQQTDPCCTSDAQPHAFLLSGPASPGTSSAASSPLKKEQPLFTLRQVGMICERLLKEREEKVREEYEEILNTKLAEQYDAFVKFTHDQIMRRYGEQPASYNLPVEYNLPVEYNLPV

SEQ ID NO: 848924 - protein, 186 aa, Homo sapiens
MACGATLKRTLDFDPLLSPASPKRRRCAPLSAPTSAAAASPQKYLRMEPSPFGDVSSRLTTEQILYNIKQEYKRMQKRRHLETSFQQTDPCCTSDAQPHAFLLSGPASPGTSSAASSPLKKEQPLFTLRQVGMICERLLKEREEKVREEYEEILNTKLAEQYDAFVKFTHDQIMRRYGEQPASYVS

SEQ ID NO: 848925 - protein, 66 aa, Homo sapiens
MNIVEAMERFGSRNGKTSKKITIADCGQLNKFDLCFILTTRSFLLELRRAPLHPICSQYPRIFVLS

SEQ ID NO: 848926 - protein, 143 aa, Homo sapiens
MACGATLKRTLDFDPLLSPASPKRRRCAPLSAPTSAAASPLSAAAATAASFSAAAASPQKYLRMEPSPFGDVSSRLTTEQILYNIKQEYKRMQKRRHLETSFQQTDPCCTSDAQPHGNIINVAGAFLSTVLCIPTINLQVGSR

SEQ ID NO: 848927 - protein, 140 aa, Homo sapiens
MEPSPFGDVSSRLTTEQILYNIKQEYKRMQKRRHLETSFQQTDPCCTSDAQPHAFLLSGPASPGTSSAASSPLKKEQPLFTLRQVGMICERLLKEREEKVREEYEEILNTKLAEQYDAFVKFTHDQIMRRYGEQPASYVS

SEQ ID NO: 848928 - protein, 203 aa, Homo sapiens; identical to SEQ ID NO: 848922

SEQ ID NO: 848929 - protein, 163 aa, Homo sapiens
MACGATLKRTLDFDPLLSPASPKRRRCAPLSAPTSAAASPLSAAAATAASFSAAAASPQKYLRMEPSPFGDVSSRLTTEQILYNIKQEYKRMQKRRHLETSFQQTDPCCTSDAQPHAFLLSGPASPGTSSAASSPLKQYDAFVKFTHDQIMRRYGEQPASYVS

SEQ ID NO: 848930 - protein, 155 aa, Homo sapiens
MACGATLKRTLDFDPLLSPASPKRRRCAPLSAPTSAAASPLSAAAATAASFSAAAASPQKYLRMEPSPFGDVSSRLTTGTSSAASSPLKKEQPLFTLRQVGMICERLLKEREEKVREEYEEILNTKLAEQYDAFVKFTHDQIMRRYGEQPASYVS

SEQ ID NO: 848931 - protein, 203 aa, Homo sapiens; identical to SEQ ID NO: 848922

SEQ ID NO: 848932 - protein, 122 aa, Homo sapiens
MIGIVSVVAGAPAEMIREDDIIRKFRRKGHISPQSGCVLAVIDWLQLLTLGLGGLRRGYSPSFSSDTADFSIVGVGGGGWMSLGRDLGLSLITHKNATLAESRPVSLAGSTTKKMLFPSTVI

SEQ ID NO: 848933 - protein, 999 aa, Homo sapiens
MVCSPVTVRIAPPDRRFSRSAIPEQIISSTLSSPSSNAPDPCAKETVLSALKEKEKKRTVEEEDQIFLDGQENKRRRHDSSGSGHSAFEPLVANGVPASFVPKPGSLKRGLNSQSSDDHLNKRSRSSSMSSLTGAYASGIPSSSRNAITSSYSSTRGISQLWKRNGPSSSPFSSPASSRSQTPERPAKKIREEELCHHSSSSTPLAADRESQGEKAADTTPRKKQNSNSQSTPGSSGQRKRKVQLLPSRRGEQLTLPPPPQLGYSITAEDLDLEKKASLQWFNQALEDKSDAASNSVTETPPITQPSFTFTLPAAAPASPPTSLLAPSTNPLLESLKKMQTPPSLPPCPESAGAATTEALSPPKTPSLLPPLGLSQSGPPGLLPSPSFDSKPPTTLLGLIPAPSMVPATDTKAPPTLQAETATKPQATSAPSPAPKQSFLFGTQNTSPSSPAAPAASSAPPMFKPIFTAPPKSEKEGPTPPGPSVTATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLHTAVPTATSSSAADFSGFGSTLATSAPATSSQPTLTFSNTSTPTFNIPFGSSAKSPLPSYPGANPQPAFGAAEGQPPGAAKPALAPSFGSSFTFGNSAAPAAAPTPAPPSMIKVVPAYVPTPIHPIFGGATHSAFGLKATASAFGAPASSQPAFGGSTAVFFGAATSSGFGATTQTASSGSSSSVFGSTTPSPFTFGGSAAPAGSGSFGINVATPGSSTTTGAFSFGAGQSGSTATSTPFAGGLGQNALGTTGQSTPFAFNVSSTTESKPVFGGTATPTFGLNTPAPGVGTSGSSLSFGASSAPAQGFVGVAPFGNTFAHQQEHSPRKGPNNLSKRKLLPAVRAQGLPRRGQASSFPTRKE

SEQ ID NO: 848934 - protein, 984 aa, Homo sapiens
MVCSPVTVRIAPPDRRFSRSAIPEQIISSTLSSPSSNAPDPCAKETVLSALKEKEKKRTVEEEDQIFLDGQENKRRRHDSSGSGHSAFEPLVANGVPASFVPKPGSLKRGLNSQSSDDHLNKRSRSSSMSSLTGAYASGIPSSSRNAITSSYSSTRGISQLWKRNGPSSSPFSSPASSRSQTPERPAKKIREEELCHHSSSSTPLAADRESQGEKAADTTPRKKQNSNSQSTPGSSGQRKRKVQLLPSRRGEQLTLPPPPQLGYSITAEDLDLEKKASLQWFNQALEDKSDAASNSVTETPPITQPSFTFTLPAAAPASPPTSLLAPSTNPLLESLKKMQTPPSLPPCPESAGAATTEALSPPKTPSLLPPLGLSQSGPPGLLPSPSFDSKPPTTLLGLIPAPSMVPATDTKAPPTLQAETATKPQATSAPSPAPKQSFLFGTQNTSPSSPAAPAASSAPPMFKPIFTAPPKSEKEGPTPPGPSVTATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLHTAVPTATSSSAADFSGFGSTLATSAPATSSQPTLTFSNTSTPTFNIPFGSSAKSPLPSYPGANPQPAFGAAEGQPPGAAKPALAPSFGSSFTFGNSAAPAAAPTPAPPSMIKVVPAYVPTPIHPIFGGATHSAFGLKATASAFGAPASSQPAFGGSTAVFFGAATSSGFGATTQTASSGSSSSVFGSTTPSPFTFGGSAAPAGSGSFGINVATPGSSTTTGAFSFGAGQSGSTATSTPFAGGLGQNALGTTGQSTPFAFNVSSTTESKPVFGGTATPTFGLNTPAPGVGTSGSSLSFGASSAPAQGFVGVAPFGSAALSFSIGAGSKTPGARQRLQARRQHTRKK

SEQ ID NO: 848935 - protein, 984 aa, Homo sapiens; identical to SEQ ID NO: 848934

SEQ ID NO: 848936 - protein, 1037 aa, Homo sapiens
MVQDCGTLPNRFVITPRRRYPIHQAQYSCLGVLPTVCWNGYHKKAVLSPRNSRMVCSPVTVRIAPPDRRFSRSAIPEQIISSTLSSPSSNAPDPCAKETVLSALKEKEKKRTVEEEDQIFLDGQENKRRRHDSSGSGHSAFEPLVANGVPASFVPKPGSLKRGLNSQSSDDHLNKRSRSSSMSSLTGAYASGIPSSSRNAITSSYSSTRGISQLWKRNGPSSSPFSSPASSRSQTPERPAKKIREEELCHHSSSSTPLAADRESQGEKAADTTPRKKQNSNSQSTPGSSGQRKRKVQLLPSRRGEQLTLPPPPQLGYSITAEDLDLEKKASLQWFNQALEDKSDAASNSVTETPPITQPSFTFTLPAAAPASPPTSLLAPSTNPLLESLKKMQTPPSLPPCPESAGAATTEALSPPKTPSLLPPLGLSQSGPPGLLPSPSFDSKPPTTLLGLIPAPSMVPATDTKAPPTLQAETATKPQATSAPSPAPKQSFLFGTQNTSPSSPAAPAASSAPPMFKPIFTAPPKSEKEGPTPPGPSVTATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLHTAVPTATSSSAADFSGFGSTLATSAPATSSQPTLTFSNTSTPTFNIPFGSSAKSPLPSYPGANPQPAFGAAEGQPPGAAKPALAPSFGSSFTFGNSAAPAAAPTPAPPSMIKVVPAYVPTPIHPIFGGATHSAFGLKATASAFGAPASSQPAFGGSTAVFFGAATSSGFGATTQTASSGSSSSVFGSTTPSPFTFGGSAAPAGSGSFGINVATPGSSTTTGAFSFGAGQSGSTATSTPFAGGLGQNALGTTGQSTPFAFNVSSTTESKPVFGGTATPTFGLNTPAPGVGTSGSSLSFGASSAPAQGFVGVAPFGSAALSFSIGAGSKTPGARQRLQARRQHTRKK

SEQ ID NO: 848937 - protein, 1008 aa, Homo sapiens
LGYTPSWSCEGTAQPSCDEPFQHTVGSTPVTVRIAPPDRRFSRSAIPEQIISSTLSSPSSNAPDPCAKETVLSALKEKEKKRTVEEEDQIFLDGQENKRRRHDSSGSGHSAFEPLVANGVPASFVPKPGSLKRGLNSQSSDDHLNKRSRSSSMSSLTGAYASGIPSSSRNAITSSYSSTRGISQLWKRNGPSSSPFSSPASSRSQTPERPAKKIREEELCHHSSSSTPLAADRESQGEKAADTTPRKKQNSNSQSTPGSSGQRKRKVQLLPSRRGEQLTLPPPPQLGYSITAEDLDLEKKASLQWFNQALEDKSDAASNSVTETPPITQPSFTFTLPAAAPASPPTSLLAPSTNPLLESLKKMQTPPSLPPCPESAGAATTEALSPPKTPSLLPPLGLSQSGPPGLLPSPSFDSKPPTTLLGLIPAPSMVPATDTKAPPTLQAETATKPQATSAPSPAPKQSFLFGTQNTSPSSPAAPAASSAPPMFKPIFTAPPKSEKEGPTPPGPSVTATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLHTAVPTATSSSAADFSGFGSTLATSAPATSSQPTLTFSNTSTPTFNIPFGSSAKSPLPSYPGANPQPAFGAAEGQPPGAAKPALAPSFGSSFTFGNSAAPAAAPTPAPPSMIKVVPAYVPTPIHPIFGGATHSAFGLKATASAFGAPASSQPAFGGSTAVFFGAATSSGFGATTQTASSGSSSSVFGSTTPSPFTFGGSAAPAGSGSFGINVATPGSSTTTGAFSFGAGQSGSTATSTPFAGGLGQNALGTTGQSTPFAFNVSSTTESKPVFGGTATPTFGLNTPAPGVGTSGSSLSFGASSAPAQGFVGVAPFGSAALSFSIGAGSKTPGARQRLQARRQHTRKK

SEQ ID NO: 848938 - protein, 646 aa, Homo sapiens
MQTPPSLPPCPESAGAATTEALSPPKTPSLLPPLGLSQSGPPGLLPSPSFDSKPPTTLLGLIPAPSMVPATDTKAPPTLQAETATKPQATSAPSPAPKQSFLFGTQNTSPSSPAAPAASSAPPMFKPIFTAPPKSEKEGPTPPGPSVTATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLHTAVPTATSSSAADFSGFGSTLATSAPATSSQPTLTFSNTSTPTFNIPFGSSAKSPLPSYPGANPQPAFGAAEGQPPGAAKPALAPSFGSSFTFGNSAAPAAAPTPAPPSMIKVVPAYVPTPIHPIFGGATHSAFGLKATASAFGAPASSQPAFGGSTAVFFGAATSSGFGATTQTASSGSSSSVFGSTTPSPFTFGGSAAPAGSGSFGINVATPGSSTTTGAFSFGAGQSGSTATSTPFAGGLGQNALGTTGQSTPFAFNVSSTTESKPVFGGTATPTFGLNTPAPGVGTSGSSLSFGASSAPAQGFVGVAPFGSAALSFSIGAGSKTPGARQRLQARRQHTRKK

SEQ ID NO: 848939 - protein, 984 aa, Homo sapiens; identical to SEQ ID NO: 848934

SEQ ID NO: 848940 - protein, 984 aa, Homo sapiens; identical to SEQ ID NO: 848934

SEQ ID NO: 848941 - protein, 984 aa, Homo sapiens; identical to SEQ ID NO: 848934

SEQ ID NO: 848942 - protein, 984 aa, Homo sapiens; identical to SEQ ID NO: 848934

SEQ ID NO: 848943 - protein, 984 aa, Homo sapiens; identical to SEQ ID NO: 848934

SEQ ID NO: 848944 - protein, 112 aa, Homo sapiens
MCKAVCKHRLQLFALFFLFGAGLGVRSGADALACEAEVGISTRSITATKKPPLSVVLGEARRQCSAPGNVLRPRWGRAGRAGASLQEKQPQCWVREQFTPSPPPRPWRTPCT

SEQ ID NO: 848945 - protein, 84 aa, Homo sapiens
KRMDRAEHKGELQTDKMMRAAAKDVHRLRGQSCKEPPEVQSFREKMAFFTRPRMNIPALSADDVYSPEKYFLCSTDQAVNLDCG

SEQ ID NO: 848946 - protein, 104 aa, Homo sapiens
MGVGWQRSERSCPGWKFASHGKPGKNGFLGLALRLSGSLHFRRLLPYSVSDAAGKALLRHPVFYYWPGLPEIWAPRVRVSGSSCPDEVLLNLSRIGGPFIFHWC

SEQ ID NO: 848947 - protein, 984 aa, Homo sapiens; identical to SEQ ID NO: 848934

SEQ ID NO: 848948 - protein, 984 aa, Homo sapiens; identical to SEQ ID NO: 848934

SEQ ID NO: 848949 - protein, 984 aa, Homo sapiens; identical to SEQ ID NO: 848934

SEQ ID NO: 848950 - protein, 646 aa, Homo sapiens; identical to SEQ ID NO: 848938

SEQ ID NO: 848951 - protein, 984 aa, Homo sapiens; identical to SEQ ID NO: 848934

SEQ ID NO: 848952 - protein, 984 aa, Homo sapiens; identical to SEQ ID NO: 848934

SEQ ID NO: 848953 - protein, 984 aa, Homo sapiens; identical to SEQ ID NO: 848934

SEQ ID NO: 848954 - protein, 984 aa, Homo sapiens; identical to SEQ ID NO: 848934

SEQ ID NO: 848955 - protein, 105 aa, Homo sapiens
MGAWRGSSSMAGRQLAWQAEHRGRVNRDPRLGPSRAYTFFPFLFLLPTLSCRMRCPARYSGCSCRSVWAGNTSSSGIKGSRRKCFPLRARKSSRLPGKNHSFIIS

SEQ ID NO: 848956 - protein, 57 aa, Homo sapiens
MGYQSQEKENDTNQTDEEVFHLLGLGYLDSPIPGDTAENKASKLPVPLGFTSWDWAI

SEQ ID NO: 848957 - protein, 67 aa, Homo sapiens
EGVRNYLILQPRSLSRLNCSFFPDREEELCHHSSSSTPLAADRESQGEKGRLLSQEEGLLLVVEVFV

SEQ ID NO: 848958 - protein, 109 aa, Homo sapiens
MEQQIRESRISLEKDIETLSELLARLGSLDTHQAPAQALNETQWALERLRLQLGSPGSLQRKLSLLEQESQQQELQIQGFESDLAEIRADKQNLEAILHSLPENCASWQ

SEQ ID NO: 848959 - protein, 1587 aa, Homo sapiens
MAAAALLLGLALLAPRAAGAGMGACYDGAGRPQRCLPVFENAAFGRLAQASHTCGSPPEDFCPHVGAAGAGAHCQRCDAADPQRHHNASYLTDFHSQDESTWWQSPSMAFGVQYPTSVNITLRLGKAYEITYVRLKFHTSRPESFAIYKRSRADGPWEPYQFYSASCQKTYGRPEGQYLRPGEDERVAFCTSEFSDISPLSGGNVAFSTLEGRPSAYNFEESPGLQEWVTSTELLISLDRLNTFGDDIFKDPKVLQSYYYAVSDFSVGGRCKCNGHASECGPDVAGQLACRCQHNTTGTDCERCLPFFQDRPWARGTAEAAHECLPCNCSGRSEECTFDRELFRSTGHGGRCHHCRDHTAGPHCERCQENFYHWDPRMPCQPCDCQSAGSLHLQCDDTGTCACKPTVTGWKCDRCLPGFHSLSEGGCRPCTCNPAGSLDTCDPRSGRCPCKENVEGNLCDRCRPGTFNLQPHNPAGCSSCFCYGHSKVCASTAQFQVHHILSDFHQGAEGWWARSVGGSEHSPQWSPNGVLLSPEDEEELTAPGKFLGDQRFSYGQPLILTFRVPPGDSPLPVQLRLEGTGLALSLRHSSLSGPQDAGHPREVELRFHLQETSEDVAPPLPPFHFQRLLANLTSLRLRVSPGPSPAGPVFLTEVRLTSARPGLSPPASWVEICSCPTGYTGQFCESCAPGYKREMPQGGPYASCVPCTCNQHGTCDPNTGICVCSHHTEGPSCERCLPGFYGNPFAGQADDCQPCPCPGQSACTTIPESREVVCTHCPPGQRGRRCEVCDDGFFGDPLGLFGHPQPCHQCQCSGNVDPNAVGNCDPLSGHCLRCLHNTTGDHCEHCQEGFYGSALAPRPADKCMPCSCHPQGSVSEQMPCDPVTGQCSCLPHVTARDCSRCYPGFFDLQPGRGCRSCKCHPLGSQEDQCHPKTGQCTCRPGVTGQACDRCQLGFFGFSIKGCRACRCSPLGAASAQCHENGTCVCRPGFEGYKCDRCHDNFFLTADGTHCQQCPSCYALVKEEAAKLKARLTLTEGWLQGSDCGSPWGPLDILLGEAPRGDVYQGHHLLPGAREAFLEQMMGLEGAVKAAREQLQRLNKGARCAQAGSQKTCTQLADLEAVLESSEEEILHAAAILASLEIPQEGPSQPTKWSHLATEARALARSHRDTATKIAATAWRALLASNTSYALLWNLLEGRVALETQRDLEDRYQEVQAAQKALRTAVAEVLPEAESVLATVQQVGADTAPYLALLASPGALPQKSRAEDLGLKAKALEKTVASWQHMATEAARTLQTAAQATLRQTEPLTKARSRLTATFASQLHQEARAALTQASSSVQAATVTVMGARTLLADLEGMKLQFPRPKDQAALQRKADSVSDRLLADTRKKTKQAERMLGNAAPLSSSAKKKGREAEVLAKDSAKLAKALLRERKQAHRRASRLTSQTQATLQQASQQVLASEARRQELEEAERVGAGLSEMEQQIRESRISLEKDIETLSELLARLGSLDTHQAPAQALNETQWALERLRLQLGSPGSLQRKLSLLEQESQQQELQIQGFESDLAEIRADKQNLEAILHSLPENCASWQ

SEQ ID NO: 848960 - protein, 1546 aa, Homo sapiens
MAAAALLLGLALLAPRAAGAGMGACYDGAGRPQRCLPVFENAAFGRLAQASHTCGSPPEDFCPHVGAAGAGAHCQRCDAADPQRHHNASYLTDFHSQDESTWWQSPSMAFGVQYPTSVNITLRLGKAYEITYVRLKFHTSRPESFAIYKRSRADGPWEPYQFYSASCQKTYGRPEGQYLRPGEDERVAFCTSEFSDISPLSGGNVAFSTLEGRPSAYNFEESPGLQEWVTSTELLISLDRLNTFGDDIFKDPKVLQSYYYAVSDFSVGGRCKCNGHASECGPDVAGQLACRCQHNTTGTDCERCLPFFQDRPWARGTAEAAHECLPCNCSGRSEECTFDRELFRSTGHGGRCHHCRDHTAGPHCERCQENFYHWDPRMPCQPCDCQSAGSLHLQCDDTGTCACKPTVTGWKCDRCLPGFHSLSEGGCRPCTCNPAGSLDTCDPRSGRCPCKENVEGNLCDRCRPGTFNLQPHNPAGCSSCFCYGHSKVCASTAQFQVHHILSDFHQGAEGWWARSVGGSEHSPQWSPNGVLLSPEDEEELTAPGKFLGDQRFSYGQPLILTFRVPPGDSPLPVQLRLEGTGLALSLRHSSLSGPQDAGHPREVELRFHLQETSEDVAPPLPPFHFQRLLANLTSLRLRVSPGPSPAGPVFLTEVRLTSARPGLSPPASWVEICSCPTGYTGQFCESCAPGYKREMPQGGPYASCVPCTCNQHGTCDPNTGICVCSHHTEGPSCERCLPGFYGNPFAGQADDCQPCPCPGQSACTTIPESREVVCTHCPPGQRGRRCEVCDDGFFGDPLGLFGHPQPCHQCQCSGNVDPNAVGNCDPLSGHCLRCLHNTTGDHCEHCQEGFYGSALAPRPADKCMPCSCHPQGSVSEQMPCDPVTGQCSCLPHVTARDCSRCYPGFFDLQPGRGCRSCKCHPLGSQEDQCHPKTGQCTCRPGVTGQACDRCQLGFFGFSIKGCRACRCSPLGAASAQCHENGTCVCRPGFEGYKCDRCHDNFFLTADGTHCQQCPSCYALVKEEAAKLKARLTLTEGWLQGSDCGSPWGPLDILLGEAPRGDVYQGHHLLPGAREAFLEQMMGLEGAVKAAREQLQRLNKGARCAQAGSQKTCTQLADLEAVLESSEEEILHAAAILASLEIPQEGPSQPTKWSHLATEARALARSHRDTATKIAATAWRALLASNTSYALLWNLLEGRVALETQRDLEDRYQEVQAAQKALRTAVAEVLPEAESVLATVQQVGADTAPYLALLASPGALPQKSRAEDLGLKAKALEKTVASWQHMATEAARTLQTAAQATLRQTEPLTKLHQEARAALTQASSSVQAATVTVMGARTLLADLEARKKTKQAERMLGNAAPLSSSAKKKGREAEVLAKDSAKLAKALLRERKQAHRRASRLTSQTQATLQQASQQVLASEARRQELEEAERVGAGLSEMEQQIRESRISLEKDIETLSELLARLGSLDTHQAPAQALNETQWALERLRLQLGSPGSLQRKLSLLEQESQQQELQIQGFESDLAEIRADKQNLEAILHSLPENCASWQ

SEQ ID NO: 848961 - protein, 1575 aa, Homo sapiens
MAAAALLLGLALLAPRAAGAGMGACYDGAGRPQRCLPVFENAAFGRLAQASHTCGSPPEDFCPHVGAAGAGAHCQRCDAADPQRHHNASYLTDFHSQDESTWWQSPSMAFGVQYPTSVNITLRLGKAYEITYVRLKFHTSRPESFAIYKRSRADGPWEPYQFYSASCQKTYGRPEGQYLRPGEDERVAFCTSEFSDISPLSGGNVAFSTLEGRPSAYNFEESPGLQEWVTSTELLISLDRLNTFGDDIFKDPKVLQSYYYAVSDFSVGGRCKCNGHASECGPDVAGQLACRCQHNTTGTDCERCLPFFQDRPWARGTAEAAHECLPCNCSGRSEECTFDRELFRSTGHGGRCHHCRDHTAGPHCERCQENFYHWDPRMPCQPCDCQSAGSLHLQCDDTGTCACKPTVTGWKCDRCLPGFHSLSEGGCRPCTCNPAGSLDTCDPRSGRCPCKENVEGNLCDRCRPGTFNLQPHNPAGCSSCFCYGHSKVCASTAQFQVHHILSDFHQGAEGWWARSVGGSEHSPQWSPNGVLLSPEDEEELTAPGKFLGDQRFSYGQPLILTFRVPPGDSPLPVQLRLEGTGLALSLRHSSLSGPQDAGHPREVELRFHLQETSEDVAPPLPPFHFQRLLANLTSLRLRVSPGPSPAGPVFLTEVRLTSARPGLSPPASWVEICSCPTGYTGQFCESCAPGYKREMPQGGPYASCVPCTCNQHGTCDPNTGICVCSHHTEGPSCERCLPGFYGNPFAGQADDCQPCPCPGQSACTTIPESREVVCTHCPPGQRGRRCEVCDDGFFGDPLGLFGHPQPCHQCQCSGNVDPNAVGNCDPLSGHCLRCLHNTTGDHCEHCQEGFYGSALAPRPADKCMPCSCHPQGSVSEQMPCDPVTGQCSCLPHVTARDCSRCYPGFFDLQPGRGCRSCKCHPLGSQEDQCHPKTGQCTCRPGVTGQACDRCQLGFFGFSIKGCRACRCSPLGAASAQCHENGTCVCRPGFEGYKCDRCHDNFFLTADGTHCQQCPSCYALVKEEAAKLKARLTLTEGWLQGSDCGSPWGPLDILLGEAPRGDVYQGHHLLPGAREAFLEQMMGLEGAVKAAREQLQRLNKGARCAQAGSQKTCTQLADLEAVLESSEEEILHAAAILASLEIPQEGPSQPTKWSHLATEARALARSHRDTATKIAATAWRALLASNTSYALLWNLLEGRVALETQRDLEDRYQEVQAAQKALRTAVAEVLPEAESVLATVQQVGADTAPYLALLASPGALPQKSRAEDLGLKAKALEKTVASWQHMATEAARTLQTAAQATLRQTEPLTKLHQEARAALTQASSSVQAATVTVMGARTLLADLEGMKLQFPRPKDQAALQRKADSVSDRLLADTRKKTKQAERMLGNAAPLSSSAKKKGREAEVLAKDSAKLAKALLRERKQAHRRASRLTSQTQATLQQASQQVLASEARRQELEEAERVGAGLSEMEQQIRESRISLEKDIETLSELLARLGSLDTHQAPAQALNETQWALERLRLQLGSPGSLQRKLSLLEQESQQQELQIQGFESDLAEIRADKQNLEAILHSLPENCASWQ

SEQ ID NO: 848962 - protein, 1575 aa, Homo sapiens; identical to SEQ ID NO: 848961

SEQ ID NO: 848963 - protein, 133 aa, Homo sapiens
MRKAEGEKRKEEELVTKGGPRSVASRASEGGGPHQNRGSLCLGRCKGLVNNLTAVIYTPQPRGLRGQSKEAEAPSALPTWGGLGKWRVLHSRCRGFCLPGILPEVWQDNADREALPAKGPEGDFALEKTWPAS

SEQ ID NO: 848964 - protein, 1587 aa, Homo sapiens; identical to SEQ ID NO: 848959

SEQ ID NO: 848965 - protein, 413 aa, Homo sapiens
MRKAEGEIPQEGPSQPTKWSHLATEARALARSHRDTATKIAATAWRALLASNTSYALLWNLLEGRVALETQRDLEDRYQEVQAAQKALRTAVAEVLPEAESVLATVQQVGADTAPYLALLASPGALPQKSRAEDLGLKAKALEKTVASWQHMATEAARTLQTAAQATLRQTEPLTKLHQEARAALTQASSSVQAATVTVMGARTLLADLEARKKTKQAERMLGNAAPLSSSAKKKGREAEVLAKDSAKLAKALLRERKQAHRRASRLTSQTQATLQQASQQVLASEARRQELEEAERVGAGLSEMEQQIRESRISLEKDIETLSELLARLGSLDTHQAPAQALNETQWALERLRLQLGSPGSLQRKLSLLEQESQQQELQIQGFESDLAEIRADKQNLEAILHSLPENCASWQ

SEQ ID NO: 848966 - protein, 1480 aa, Homo sapiens
MAAAALLLGLALLAPRAAGAGMGACYDGAGRPQRCLPVFENAAFGRLAQASHTCGSPPEDFCPHVGAAGAGAHCQRCDAADPQRHHNASYLTDFHSQDESTWWQSPSMAFGVQYPTSVNITLRLGKAYEITYVRLKFHTSRPESFAIYKRSRADGPWEPYQFYSASCQKTYGRPEGQYLRPGEDERVAFCTSEFSDISPLSGGNVAFSTLEGRPSAYNFEESPGLQEWVTSTELLISLDRLNTFGDDIFKDPKVLQSYYYAVSDFSVGGRCKCNGHASECGPDVAGQLACRCQHNTTGTDCERCLPFFQDRPWARGTAEAAHECLPCNCSGRSEECTFDRELFRSTGHGGRCHHCRDHTAGPHCERCQENFYHWDPRMPCQPCDCQSAGSLHLQCDDTGTCACKPTVTGWKCDRCLPGFHSLSEGGCRPCTCNPAGSLDTCDPRSGRCPCKENVEGNLCDRCRPGTFNLQPHNPAGCSSCFCYGHSKVCASTAQFQVHHILSDFHQGAEGWWARSVGGSEHSPQWSPNGVLLSPEDEEELTAPGKFLGDQRFSYGQPLILTFRVPPGDSPLPVQLRLEGTGLALSLRHSSLSGPQDAGHPREVELRFHLQETSEDVAPPLPPFHFQRLLANLTSLRLRVSPGPSPAGPVFLTEVRLTSARPGLSPPASWVEICSCPTGYTGQFCESCAPGYKREMPQGGPYASCVPCTCNQHGTCDPNTGICVCSHHTEGPSCERCLPGFYGNPFAGQADDCQPCPCPGQSACTTIPESREVVCTHCPPGQRGRRCEVCDDGFFGDPLGLFGHPQPCHQCQCSGNVDPNAVGNCDPLSGHCLRCLHNTTGDHCEHCQEGFYGSALAPRPADKCMPCSCHPQGSVSEQMPCDPVTGQCSCLPHVTARDCSRCYPGFFDLQPGRGCRSCKCHPLGSQEDQCHPKTGQCTCRPGVTGQACDRCQLGFFGFSIKGCRACRCSPLGAASAQCHENGTCVCRPGFEGYKCDRCHDNFFLTADGTHCQQCPSCYALVKEEAAKLKARLTLTEGWLQGSDCGSPWGPLDILLGEAPRGDVYQGHHLLPGAREAFLEQMMGLEGAVKAAREQLQRLNKGARCAQAGSQKTCTQLADLEAVLESSEEEILHAAAILASLEIPQEGPSQPTKWSHLATEARALARSHRDTATKIAATAWRALLASNTSYALLWNLLEGRVALETQRDLEDRYQEVQAAQKALRTAVAEVLPEAESVLATVQQVGADTAPYLALLASPGALPQKSRAEDLGLKAKALEKTVASWQHMATEAARTLQTAAQATLRQTEPLTKLHQEARAALTQASSSVQAATVTVMGARTLLADLEGMKLQFPRPKDQAALQRKADSVSDRLLADKLCQLAVRAAQIPGTHSPTCCLHDPGGAHYPTGVPIQTFPGAGCCELDPVWIVTLPADSVCGFFPASRTECAYPVHLDMSAHSHPCTCINGHTPVSITYTREGACLCV

SEQ ID NO: 848967 - protein, 80 aa, Homo sapiens
HTDMIDEDGYMRNLKLNYEVTHSFLHDRLYYLNGIECAASAMEMSAIAAHNAALLAYHRWNGHTDMIDQDGLYEKLKTEL

SEQ ID NO: 848968 - protein, 469 aa, Homo sapiens
SGGRTAGLLRPAAELVEAMGRVVAELVSSLLGLWLLLCSCGCPEGAELRAPPDKIAIIGAGIGGTSAAYYLRQKFGKDVKIDLFEREEVGGRLATMMVQGQEYEAGGSVIHPLNLHMKRFVKDLGLSAVQASGGLLGIYNGETLVFEESNWFIINVIKLVWRYGFQSLRMHMWVEDVLDKFMRIYRYQSHDYAFSSVEKLLHALGGDDFLGMLNRTLLETLQKAGFSEKFLNEMIAPVMRVNYGQSTDINAFVGAVSLSCSDSGLWAVEGGNKLVCSGLLQASKSNLISGSVMYIEEKTKTKYTGNPTKMYEVVYQIGTETRSDFYDIVLVATPLNRKMSNITFLNFDPPIEEFHQYYQHIVTTLVKGELNTSIFSSRPIDKFGLNTVLTTDNSDLFINSIGIVPSVREKEDPEPSTDGTYVWKIFSQETLTKAQILKLFLSYDYAVKKPWLAYPHYKPPEKCPSIISG

SEQ ID NO: 848969 - protein, 523 aa, Homo sapiens
SGGRTAGLLRPAAELVEAMGRVVAELVSSLLGLWLLLCSCGCPEGAELRAPPDKIAIIGAGIGGTSAAYYLRQKFGKDVKIDLFEREEVGGRLATMMVQGQEYEAGGSVIHPLNLHMKRFVKDLGLSAVQASGGLLGIYNGETLVFEESNWFIINVIKLVWRYGFQSLRMHMWVEDVLDKFMRIYRYQSHDYAFSSVEKLLHALGGDDFLGMLNRTLLETLQKAGFSEKFLNEMIAPVMRVNYGQSTDINAFVGAVSLSCSDSGLWAVEGGNKLVCSGLLQASKSNLISGSVMYIEEKTKTKYTGNPTKMYEVVYQIGTETRSDFYDIVLVATPLNRKMSNITFLNFDPPIEEFHQYYQHIVTTLVKGELNTSIFSSRPIDKFGLNTVLTTDNSDLFINSIGIVPSVREKEDPEPSTDGTYVWKIFSQETLTKAQILKLFLSYDYAVKKPWLAYPHYKPPEKCPSIILHDRLYYLNGIECAASAMEMSAIAAHNAALLAYHRWNGHTDMIDQDGLYEKLKTEL

SEQ ID NO: 848970 - protein, 523 aa, Homo sapiens; identical to SEQ ID NO: 848969

SEQ ID NO: 848971 - protein, 109 aa, Homo sapiens
CAISRSMRSSGADAGRCLVTARAPGSVPAPREGSAGSRGPGAPVPGTCLGTWQRAWPWAWRRRRPGSAGRGRRVGVVLDHRRRVHCSRRELSSDPAAPRASQEVHLLLP

SEQ ID NO: 848972 - protein, 167 aa, Homo sapiens
MVISGEICEICLSVPPEEILCEVCRKTFKRKDYLKQHMKTHAPERDVCRCPREGCGRTYTTVFNLQSHILSFHEESRPFVCEHAGCGKTFAMKQSLTRHAVVHDPDKKKMKLKVKKSREKRSLASHLSGYIPPKRKQGQGLSLCQNGESPNCVEDKMLSTVAVLTLG

SEQ ID NO: 848973 - protein, 251 aa, Homo sapiens
RLGSEAGCWGAVGRARRFPARVSARGSAPGPGLGGAGALDPPAVVAESVSSLTIADAFIAAGESSAPTPPRPALPRRFICSFPDCSANYSKAWKLDAHLCKHTGERPFVCDYEGCGKAFIRDYHLSRHILTHTGEKPFVCAANGCDQKFNTKSNLKKHFERKHENQQKQYICSFEDCKKTFKKHQQLKIHQCQHTNEPLFKCTQEGCGKHFASPSKLKRHAKAHEGYVCQNRMFLCGKNMDGTSETCERNP

SEQ ID NO: 848974 - protein, 109 aa, Homo sapiens; identical to SEQ ID NO: 848971

SEQ ID NO: 848975 - protein, 109 aa, Homo sapiens; identical to SEQ ID NO: 848971

SEQ ID NO: 848976 - protein, 109 aa, Homo sapiens; identical to SEQ ID NO: 848971

SEQ ID NO: 848977 - protein, 109 aa, Homo sapiens; identical to SEQ ID NO: 848971

SEQ ID NO: 848978 - protein, 109 aa, Homo sapiens; identical to SEQ ID NO: 848971

SEQ ID NO: 848979 - protein, 184 aa, Homo sapiens
MPRPTRAMYVKTGCSFVAKTWTELLKHVRETHKEEILCEVCRKTFKRKDYLKQHMKTHAPERDVCRCPREGCGRTYTTVFNLQSHILSFHEESRPFVCEHAGCGKTFAMKQSLTRHAVVHDPDKKKMKLKVKKSREKRSLASHLSGYIPPKRKQGQGLSLCQNGESPNCVEDKMLSTVAVLTLG

SEQ ID NO: 848980 - protein, 115 aa, Homo sapiens
MACCAANGCDQKFNTKSNLKKHFERKHENQQKQYICSFEDCKKTFKKHQQLKIHQCQHTNEPLFKCTQEGCGKHFASPSKLKRHAKAHEGYVCQNRMFLCGKNMDGTSETCERNP

SEQ ID NO: 848981 - protein, 109 aa, Homo sapiens; identical to SEQ ID NO: 848971

SEQ ID NO: 848982 - protein, 109 aa, Homo sapiens; identical to SEQ ID NO: 848971

SEQ ID NO: 848983 - protein, 228 aa, Homo sapiens
AARPLGGHHLGGGPFGAGAGALDPPAVVAESVSSLTIADAFIAAGESSAPTPPRPALPRRFICSFPDCSANYSKAWKLDAHLCKHTGERPFVCDYEGCGKAFIRDYHLSRHILTHTGEKPFVCAANGCDQKFNTKSNLKKHFERKHENQQKQYIQSLTRHAVVHDPDKKKMKLKVKKSREKRSLASHLSGYIPPKRKQGQGLSLCQNGESPNCVEDKMLSTVAVLTLG

SEQ ID NO: 848984 - protein, 109 aa, Homo sapiens; identical to SEQ ID NO: 848971

SEQ ID NO: 848985 - protein, 109 aa, Homo sapiens; identical to SEQ ID NO: 848971

SEQ ID NO: 848986 - protein, 109 aa, Homo sapiens; identical to SEQ ID NO: 848971

SEQ ID NO: 848987 - protein, 109 aa, Homo sapiens; identical to SEQ ID NO: 848971

SEQ ID NO: 848988 - protein, 109 aa, Homo sapiens; identical to SEQ ID NO: 848971

SEQ ID NO: 848989 - protein, 234 aa, Homo sapiens
AARPLGGHHLGGGPFGAGAGALDPPAVVAESVSSLTIADAFIAAGESSAPTPPRPALPRRFICSFPDCSANYSKAWKLDAHLCKHTGERPFVCDYEGCGKAFIRDYHLSRHILTHTGEKPFVCAANGCDQKFNTKSNLKKHFERKHENQQKQYICSFEDCKKTFKKHQQLKIHQCQHTNEPLFKCTQEGCGKHFASPSKLKRHAKAHEGYVCQNRMFLCGKNMDGTSETCERNP

SEQ ID NO: 848990 - protein, 109 aa, Homo sapiens; identical to SEQ ID NO: 848971

SEQ ID NO: 848991 - protein, 109 aa, Homo sapiens; identical to SEQ ID NO: 848971

SEQ ID NO: 848992 - protein, 109 aa, Homo sapiens; identical to SEQ ID NO: 848971

SEQ ID NO: 848993 - protein, 116 aa, Homo sapiens
LSAKCLNLLNAIIMIKVLIWKQTLCKLVYWETIPTETVLLFQMLYDSSNLFEIKQNFTVTKWVKAEILYSLQNCFILRILLRTVHFVLTFHKTNEPLQFNSAVLKTVRRPLRNISS

SEQ ID NO: 848994 - protein, 282 aa, Homo sapiens
INAECPLRAGELSNHLNEIGFIPDLYAIPWFLTMFTHVFPLHKIFHLWDTLLLGNSSFPFCIGVAILQQLRDRLLANGFNECILLFSDLPEIDIERCVRESINLFCWTPKSATYRQHAQPPKPSSDSSGGRSSAPYFSAECPDPPKTDLSRESIPLNDLKSEVSPRISAEDLIDLCELTVTGHFKTPSKKTKSSKPKLLVVDIRNSEETYSWPFRSITFINAATQRSYPGPNVVPKSRSWPRRCNHGWACGEIQLVKGKKQAHTIKKGAVARSHTIVPHSYS

SEQ ID NO: 848995 - protein, 830 aa, Homo sapiens
MFPLKDAEMGAFTFFASALPHDVCGSNGLPLTPNSIKILGRFQILKTITHPRLCQYVDISRGKHERLVVVAEHCERSLEDLLRERKPVRYPSYLAPEVIAQGIFKTTDHMPSKKPLPSGPKSDVWSLGIILFELCVGRKLFQSLDISERLKFLLTLDCVDDTLIVLAEEHGCLDIIKELPETVIDLLNKCLTFHPSKRPTPDELMKDKVFSEVSPLYTPFTKPASLFSSSLRCADLTLPEDISQLCKDINNDYLAERSIEEVYYLWCLAGGDLEKELVNKEIIRSKPPICTLPNFLFEDGESFGQGRDRSSLLDDTTVTLSLCQLRNRLKDVGGEAFYPLLEDDQSNLPHSNSNNELSAAATLPLIIREKDTEYQLNRIILFDRLLKAYPYKKNQIWKEARVDIPPLMRGLTWAALLGVEGAIHAKYDAIDKDTPIPTDRQIEVDIPRCHQYDELLSSPEGHAKFRRVLKAWVVSHPDLVYWQGLDSLCAPFLYLNFNNEALAYACMSAFIPKYLYNFFLKDNSHVIQEYLTVFSQMIAFHDPELSNHLNEIGFIPDLYAIPWFLTMFTHVFPLHKIFHLWDTLLLGNSSFPFCIGVAILQQLRDRLLANGFNECILLFSDLPEIDIERCVRESINLFCWTPKSATYRQHAQPPKPSSDSSGGRSSAPYFSAECPDPPKTDLSRESIPLNDLKSEVSPRISAEDLIDLCELTVTGHFKTPSKKTKSSKPKLLVVDIRNSEDFIRGHISGSINIPFSAAFTAEGELTQGPYTAMLQNFKGKVIVIVGHVAKHTAEFAAHLVKMKYPRICILDGGINKIKPTGLLTIPSPQI

SEQ ID NO: 848996 - protein, 423 aa, Homo sapiens [sequence omitted]

SEQ ID NO: 848997 - protein, 319 aa, Homo sapiens
LLANGFNECILLFSDLPEYLTVFSQMIAFHDPELSNHLNEIGFIPDLYAIPWFLTMFTHVFPLHKIFHLWDTLLLGNSSFPFCIGVAILQQLRDRLLANGFNECILLFSDLPEIDIERCVRESINLFCWTPKSATYRQHAQPPKPSSDSSGGRSSAPYFSAECPDPPKTDLSRESIPLNDLKSEVSPRISAEDLIDLCELTVTGHFKTPSKKTKSSKPKLLVVDIRNSEDFIRGHISGSINIPFSAAFTAEGELTQGPYTAMLQNFKGKVIVIVGHVAKHTAEFAAHLVKMKYPRICILDGGINKIKPTGLLTIPSPQI

SEQ ID NO: 848998 - protein, 761 aa, Homo sapiens
MFPLKDAEMGAFTFFASALPHDVCGSNGLPLTPNSIKILGRFQILKTITHPRLCQYVDISRGKHERLVVVAEHCERSLEDLLRERKPVRYPSYLAPEVIAQGIFKTTDHMPSKKPLPSGPKSDVWSLGIILFELCVGRKLFQSLDISERLKFLLTLDCVDDTLIVLAEEHGCLDIIKELPETVIDLLNKCLTFHPSKRPTPDELMKDKVFSEVSPLYTPFTKPASLFSSSLRCADLTLPEDISQLCKDINNDYLAERSIEEVYYLWCLAGGDLEKELVNKEIIRSKPPICTLPNFLFEDGESFGQGRDRSSLLDDTTVTLSLCQLRNRLKDVGGEAFYPLLEDDQSNLPHSNSNNELSAAATLPLIIREKDTEYQLNRIILFDRLLKAYPYKKNQIWKEARVDIPPLMRGLTWAALLGVEGAIHAKYDAIDKDTPIPTDRQIEVDIPRCHQYDELLSSPEGHAKFRRVLKAWVVSHPDLVYWQGLDSLCAPFLYLNFNNEALAYACMSAFIPKYLYNFFLKDNSHVIQEYLTVFSQMIAFHDPELSNHLNEIGFIPDLYAIPWFLTMFTHVFPLHKIFHLWDTLLLGNSSFPFCIGVAILQQLRDRLLANGFNECILLFSDLPEIDIERCVRESINLFCWTPKSATYRQHAQPPKPSSDSSGGRSSAPYFSAECPDPPKTDLSRESIPLNDLKSEVSPRISAEDLIDLCELTVTGHFKTPSKKTKSSKPKLLVVDIRNSEESYIFTTLPHKAQEIQLTRQI

SEQ ID NO: 848999 - protein, 213 aa, Homo sapiens
MFPLKDAEMGAFTFFASALPHDVCGSNGLPLTPNSIKILGRFQILKTITHPRLCQYVDISRGKHERLVVVAEHCERSLEDLLRERKPVRYPSYLAPEVIAQGIFKTTDHMPSKKPLPSGPKSDVWSLGIILFELCVGRKLFQSLDISERLKFLLTLDCVDDTLIVLAEEHGCLDIIKELPETVIDLLNKCLTFHPSKRLILFRDWDYIEILYA

SEQ ID NO: 849000 - protein, 213 aa, Homo sapiens; identical to SEQ ID NO: 848999

SEQ ID NO: 849001 - protein, 152 aa, Homo sapiens [sequence omitted]

SEQ ID NO: 849002 - protein, 830 aa, Homo sapiens; identical to SEQ ID NO: 848995

SEQ ID NO: 849003 - protein, 584 aa, Homo sapiens
MFPLKDAEMGAFTFFASALPHDVCGSNGLPLTPNSIKILGRFQILKTITHPRLCQYVDISRGKHERLVVVAEHCERSLEDLLRERKPVRYPSYLAPEVIAQGIFKTTDHMPSKKPLPSGPKSDVWSLGIILFELCVGRKLFQSLDISERLKFLLTLDCVDDTLIVLAEEHGCLDIIKELPETVIDLLNKCLTFHPSKRPTPDELMKDKVFSEVSPLYTPFTKPASLFSSSLRCADLTLPEDISQLCKDINNDYLAERSIEEVYYLWCLAGGDLEKELVNKEIIRSKPPICTLPNFLFEDGESFGQGRDRSSLLDDTTVTLSLCQLRNRLKDVGGEAFYPLLEDDQSNLPHSNSNNELSAAATLPLIIREKDTEYQLNRIILFDRLLKAYPYKKNQIWKEARVDIPPLMRGLTWAALLGVEGAIHAKYDAIDKDTPIPTDRQIEVDIPRCHQYDELLSSPEGHAKFRRVLKAWVVSHPDLVYWQGLDSLCAPFLYLNFNNEALAYACMSAFIPKYLYNFFLKDNSHVIQEYLTVFSQMIAFHDPELSNHLNEIGFIPDMYFHYTKFSTSGIPYYLGIPLSHSVLE

SEQ ID NO: 849004 - protein, 584 aa, Homo sapiens; identical to SEQ ID NO: 849003

SEQ ID NO: 849005 - protein, 489 aa, Homo sapiens
MKVDRTKLKKTPTEAPADCRALIDKLKVCNDEQLLLELQQIKTWNIGKCELYHWVDLLDRFDGILADAGQTVENMSWMLVCDRPEREQLKMLLLAVLNFTALLIEYSFSRHLYSSIEHLTTLLASSDMQVVLAVLNLLYVFSKRSNYITRLGSDKRTPLLTRLQHLAESWGGKENGFGLAECCRDLHMMKYPPSATTLHFEFYADPGAEVKIEKRTTSNTLHYIHIEQLDKISESPSEIMESLTKMYSIPKDKQMLLFTHIRLAHGFSNHRKRLQAVQARLHAISILVYSNALQESANSILYNGLIEELVDVLQITDKQLMEIKAASLRTLTSIVHLERTPKLSSIIDCTGTASYHGFLPVLVRNCIQAMIDPSMDPYPHQFATALFSFLYHLASYDAGGEALVSCGMMEALLKVIKFLGDEQRPERVKPFMTGAAEQIKHILANFKNYQFFIGENMNPDGMVALLDYREDGVTPYMIFFKDGLEMEKC

SEQ ID NO: 849006 - protein, 172 aa, Homo sapiens
MKVDRTKLKKTPTEAPADCRALIDKLKVCNDEQLLLELQQIKTWNIGKCELYHWVDLLDRFDGILADAGQTVENMSWMLVCDRPEREQLKMLLLAVLNFTALLIEYSFSRHLYSSIEHLTTLLASSDMQVVLAVLNLLYVFSKRSNYITRLGSDKRTPLLTRLQHLAEVSLG

SEQ ID NO: 849007 - protein, 68 aa, Homo sapiens
LPTSLVDPSMDPYPHQFATALFSFLYHLASYDAGGEATPLCTYPRAFARAVSGCLSMLFPVSRGSSDA

SEQ ID NO: 849008 - protein, 489 aa, Homo sapiens; identical to SEQ ID NO: 849005

SEQ ID NO: 849009 - protein, 568 aa, Homo sapiens
SGVSSLQSLRSCTGVLRVAASSPVAGLNETRRTEAAATTAPPPRPPPQLLLVPVPLPPSSGPALLRRRLPPRPAMPLYSVTVKWGKEKFEGVELNTDEPPMVFKAQLFALTGVQPARQKVMVKGGTLKDDDWGNIKIKNGMTLLMMGSADALPEEPSAKTVFVEDMTEEQLASAMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGKENQLQLSCFINQEVKYLFTGLKLRLQEEITKQSPTLQRNALYIKSSKISRLPAYLTIQMVRFFYKEKESVNAKVLKDVKFPLMLDMYELCTPELQEKMVSFRSKFKDLEDKKVNQQPNTSDKKSSPQKEVKYEPFSFADDIGSNNCGYYDLQAVLTHQGRSSSSGHYVSWVKRKQDEWIKFDDDKVSIVTPEDILRLSGGGDWHIAYVLLYGPRRVEIMEEESEQ

SEQ ID NO: 849010 - protein, 494 aa, Homo sapiens
MPLYSVTVKWGKEKFEGVELNTDEPPMVFKAQLFALTGVQPARQKVMVKGGTLKDDDWGNIKIKNGMTLLMMGSADALPEEPSAKTVFVEDMTEEQLASAMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGKENQLQLSCFINQEVKYLFTGLKLRLQEEITKQSPTLQRNALYIKSSKISRLPAYLTIQMVRFFYKEKESVNAKVLKDVKFPLMLDMYELCTPELQEKMVSFRSKFKDLEDKKVNQQPNTSDKKSSPQKEVKYEPFSFADDIGSNNCGYYDLQAVLTHQGRSSSSGHYVSWVKRKQDEWIKFDDDKVSIVTPEDILRLSGGGDWHIAYVLLYGPRRVEIMEEESEQ

SEQ ID NO: 849011 - protein, 332 aa, Homo sapiens [sequence omitted]

SEQ ID NO: 849012 - protein, 346 aa, Homo sapiens
MFALSLTLRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGKENQLQLSCFINQEVKYLFTGLKLRLQEEITKQSPTLQRNALYIKSSKISRLPAYLTIQMVRFFYKEKESVNAKVLKDVKFPLMLDMYELCTPELQEKMVSFRSKFKDLEDKKVNQQPNTSDKKSSPQKEVKYEPFSFADDIGSNNCGYYDLQAVLTHQGRSSSSGHYVSWVKRKQDEWIKFDDDKVSIVTPEDILRLSGGGDWHIAYVLLYGPRRVEIMEEESEQ

SEQ ID NO: 849013 - protein, 568 aa, Homo sapiens; identical to SEQ ID NO: 849009

SEQ ID NO: 849014 - protein, 496 aa, Homo sapiens
SGVSSLQSLRSCTGVLRVAASSPVAGLNETRRTEAAATTAPPPRPPPQLLLVPVPLPPSSGPALLRRRLPPRPAMPLYSVTVKWGKEKFEGVELNTDEPPMVFKAQLFALTGVQPARQKVMVKGGTLKDDDWGNIKIKNGMTLLMMGSADALPEEPSAKTVFVEDMTEEQLASAMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGKENQLQLSCFINQEVKYLFTGLKLRLQEEITKQSPTLQRNALYIKSSKISRLPAYLTIQMVRFFYKEKESVNAKVLKDVKFPLMLDMYELCTPELQEKMVSFRSKFKDLEDKKVNQQPNTSDKKSSPQKEVKYEPFSFADDMGPIMVVIRLQAY

SEQ ID NO: 849015 - protein, 175 aa, Homo sapiens
MPLYSVTVKWGKEKFEGVELNTDEPPMVFKAQLFALTGVQPARQKVMVKGGTLKDDDWGNIKIKNGMTLLMMGSADALPEEPSAKTVFVEDMTEEQLASAMELPCGLTNLGNTCYMNATVQCIRSVPELKDALKRYAGALRASGEMASAQYITAALRDLFDSMDFPQFAEGERTV

SEQ ID NO: 849016 - protein, 214 aa, Homo sapiens
MPLYSVTVKWGKEKFEGVELNTDEPPMVFKAQLFALTGVQPARQKVMVKGGTLKDDDWGNIKIKNMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETELSSALEELLKRKLSTELGVVGL

SEQ ID NO: 849017 - protein, 111 aa, Homo sapiens
MPLYSVTVKWGKEKFEGVELNTDEPPMVFKAQLFALTGVQPARQKVMVKGGTLKDDDWGNIKIMDDSTNDGVNLLLFHNNPYSFYVDRQTWLTLCPRNVRIYVYVFGGVLY

SEQ ID NO: 849018 - protein, 494 aa, Homo sapiens; identical to SEQ ID NO: 849010

SEQ ID NO: 849019 - protein, 494 aa, Homo sapiens; identical to SEQ ID NO: 849010

SEQ ID NO: 849020 - protein, 459 aa, Homo sapiens
MPLYSVTVKWGKEKFEGVELNTDEPPMVFKAQLFALTGVQPARQKVMVKGGTLKDDDWGNIKIKNMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGKENQLQLSCFINQEVKYLFTGLKLRLQEEITKQSPTLQRNALYIKSSKISRLPAYLTIQMVRFFYKEKESVNAKVLKDVKFPLMLDMYELCTPELQEKMVSFRSKFKDLEDKKVNQQPNTSDKKSSPQKEVKYEPFSFADDIGSNNCGYYDLQAVLTHQGRSSSSGHYVSWVKRKQDEWIKFDDDKVSIVTPEDILRLSGGGDWHIAYVLLYGPRRVEIMEEESEQ

SEQ ID NO: 849021 - protein, 568 aa, Homo sapiens; identical to SEQ ID NO: 849009

SEQ ID NO: 849022 - protein, 365 aa, Homo sapiens
SGVSSLQSLRSCTGVLRVAASSPVAGLNETRRTEAAATTAPPPRPPPQLLLVPVPLPPSSGPALLRRRLPPRPAMPLYSVTVKWGKEKFEGVELNTDEPPMVFKAQLFALTGVQPARQKVMVKGGTLKDDDWGNIKIKNGMTLLMMGSADALPEEPSAKTVFVEDMTEEQLASAMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGFTGLKLRLQEESPNKAHVARNAL

SEQ ID NO: 849023 - protein, 166 aa, Homo sapiens
MPLYSVTVKWGKEKFEGVELNTDEPPMVFKAQLFALTGVQPARQKVMVKGGTLKDDDWGNIKIKNGMTLLMMGSADALPEEPSAKTVFVEDMTEEQLASAMELPCGLTNLGNTCYMNATVQCIRSVPELKDALKRYAGALRASGEMASAQYITADLPTLDFYSKWN

SEQ ID NO: 849024 - protein, 2725 aa, Homo sapiens
MEQTDCKPYQPLPKVKHEMDLAYTSSSDESEDGRKPRQSYNSRETLHEYNQELRMNYNSQSRKRKEVEKSTQEMEFCETSHTLCSGYQTDMHSVSRHGYQLEMGSDVDTETEGAASPDHALRMWIRGMKSEHSSCLSSRANSALSLTDTDHERKSDGENGFKFSPVCCDMEAQAGSTQDVQSSPHNQFTFRPLPPPPPPPHACTCARKPPPAADSLQRRSMTTRSQPSPAAPAPPTSTQDSVHLHNSWVLNSNIPLETRHSLFKHGSGSSAIFSAASQNYPLTSNTVYSPPPRPLPRSTFSRPAFTFNKPYRCCNWKCTALSATAITVTLALLLAYVIAVHLFGLTWQLQPVEGELYANGVSKGNRGTESMDTTYSPIGGKVSDKSEKKVFQKGRAIDTGEVDIGAQVMQTIPPGLFWRFQITIHHPIYLKFNISLAKDSLLGIYGRRNIPPTHTQFDFVKLMDGKQLVKQDSKGSDDTQHSPRNLILTSLQETGFIEYMDQGPWYLAFYNDGKKMEQVFVLTTAIEIMDDCSTNCNGNGECISGHCHCFPGFLGPDCARDSCPVLCGGNGEYEKGHCVCRHGWKGPECDVPEEQCIDPTCFGHGTCIMGVCICVPGYKGEICEEEDCLDPMCSNHGICVKGECHCSTGWGGVNCETPLPVCQEQCSGHGTFLLDAGVCSCDPKWTGSDCSTELCTMECGSHGVCSRGICQCEEGWVGPTCEERSCHSHCTEHGQCKDGKCECSPGWEGDHCTIAHYLDAVRDGCPGLCFGNGRCTLDQNGWHCVCQVGWSGTGCNVVMEMLCGDNLDNDGDGLTDCVDPDCCQQSNCYISPLCQGSPDPLDLIQQSQTLFSQHTSRLFYDRIKFLIGKDSTHVIPPEVSFDSRRACVIRGQVVAIDGTPLVGVNVSFLHHSDYGFTISRQDGSFDLVAIGGISVILIFDRSPFLPEKRTLWLPWNQFIVVEKVTMQRVVSDPPSCDISNFISPNPIVLPSPLTSFGGSCPERGTIVPELQVVQEEIPIPSSFVRLSYLSSRTPGYKTLLRILLTHSTIPVGMIKVHLTVAVEGRLTQKWFPAAINLVYTFAWNKTDIYGQKVWGLAEALVSVGYEYETCPDFILWEQRTVVLQGFEMDASNLGDWSLNKHHILNPQSGIIHKGNGENMFISQQPPVISTIMGNGHQRSVACTNCNGPAHNNKLFAPVALASGPDGSVYVGDFNFVRRIFPSGNSVSILELSTSPAHKYYLAMDPVSESLYLSDTNTRKVYKLKSLVETKDLSKNFEVVAGTGDQCLPFDQSHCGDGGRASEASLNSPRGITVDRHGFIYFVDGTMIRKIDENAVITTVIGSNGLTSTQPLSCDSGMDITQVRLEWPTDLAVNPMDNSLYVLDNNIVLQISENRRVRIIAGRPIHCQVPGIDHFLVSKVAIHSTLESARAISVSHSGLLFIAETDERKVNRIQQVTTNGEIYIIAGAPTDCDCKIDPNCDCFSGDGGYAKDAKMKAPSSLAVSPDGTLYVADLGNVRIRTISRNQAHLNDMNIYEIASPADQELYQFTVNGTHLHTLNLITRDYVYNFTYNSEGDLGAITSSNGNSVHIRRDAGGMPLWLVVPGGQVYWLTISSNGVLKRVSAQGYNPALMTYPGNTGLLATKSNENGWTTVYEYDPEGHLTNATFPTGEVSSFHSDLEKLTKVELDTSNRENVLMSTNLTATSTIYILKQENTQSTYRVNPDGSLRVTFASGMEIGLSSEPHILAGAVNPTLGKCNISLPGEHNANLIEWRQRKEQNKGNVSAFERRLRAHNRNLLSIDFDHITRTGKIYDDHRKFTLRILYDQTGRPILWSPVSRYNEVNITYSPSGLVTFIQRGTWNEKMEYDQSGKIISRTWADGKIWSYTYLEKSVMLLLHSQRRYIFEYDQSDCLLSVTMPSMVRHSLQTMLSVGYYRNIYTPPDSSTSFIQDYSRDGRLLQTLHLGTGRRVLYKYTKQARLSEVLYDTTQVTLTYEESSGVIKTIHLMHDGFICTIRYRQTGPLIGRQIFRFSEEGLVNARFDYSYNNFRVTSMQAVINETPLPIDLYRYVDVSGRTEQFGKFSVINYDLNQVITTTVMKHTKIFSANGQVIEVQYEILKAIAYWMTIQYDNVGRMVICDIRVGVDANITRYFYEYDADGQLQTVSVNDKTQWRYSYDLNGNINLLSHGKSARLTPLRYDLRDRITRLGEIQYKMDEDGFLRQRGNDIFEYNSNGLLQKAYNKASGWTVQYYYDGLGRRVASKSSLGQHLQFFYADLTNPIRVTHLYNHTSSEITSLYYDLQGHLIAMELSSGEEYYVACDNTGTPLAVFSSRGQVIKEILYTPYGDIYHDTYPDFQVIIGFHGGLYDFLTKLVHLGQRDYDVVAGRWTTPNHHIWKQLNLLPKPFNLYSFENNYPVGKIQDVAKYTTDIRSWLELFGFQLHNVLPGFPKPELENLELTYELLRLQTKTQEWDPGKTILGIQCELQKQLRNFISLDQLPMTPRYNDGRCLEGGKQPRFAAVPSVFGKGIKFAIKDGIVTADIIGVANEDSRRLAAILNNAHYLENLHFTIEGRDTHYFIKLGSLEEDLVLIGNTGGRRILENGVNVTVSQMTSLLNGRTRRFADIQLQHGALCFNIRYGTTVEEEKNHVLEIARQRAVAQAWTKEQRRLQEGEEGIRAWTEGEKQQLLSTGRVQGYDGYFVLSVEQYLELSDSANNIHFMRQSEIGRR

SEQ ID NO: 849025 - protein, 787 aa, Homo sapiens
MEQTDCKPYQPLPKVKHEMDLAYTSSSDESEDGRKPRQSYNSRETLHEYNQELRMNYNSQSRKRKEVEKSTQEMEFCETSHTLCSGYQTDMHSVSRHGYQLEMGSDVDTETEGAASPDHALRMWIRGMKSEHSSCLSSRANSALSLTDTDHERKSDGENGFKFSPVCCDMEAQAGSTQDVQSSPHNQFTFRPLPPPPPPPHACTCARKPPPAADSLQRRSMTTRSQPSPAAPAPPTSTQDSVHLHNSWVLNSNIPLETRHSLFKHGSGSSAIFSAASQNYPLTSNTVYSPPPRPLPRSTFSRPAFTFNKPYRCCNWKCTALSATAITVTLALLLAYVIAVHLFGLTWQLQPVEGELYANGVSKGNRGTESMDTTYSPIGGKVSDKSEKKVFQKGRAIDTGEVDIGAQVMQTIPPGLFWRFQITIHHPIYLKFNISLAKDSLLGIYGRRNIPPTHTQFDFVKLMDGKQLVKQDSKGSDDTQHSPRNLILTSLQETGFIEYMDQGPWYLAFYNDGKKMEQVFVLTTAIEIMDDCSTNCNGNGECISGHCHCFPGFLGPDCARDSCPVLCGGNGEYEKGHCVCRHGWKGPECDVPEEQCIDPTCFGHGTCIMGVCICVPGYKGEICEEEDCLDPMCSNHGICVKGECHCSTGWGGVNCETPLPVCQEQCSGHGTFLLDAGVCSCDPKWTGSDCSTELCTMECGSHGVCSRGICQCEEGWVGPTCEERSCHSHCTEHGQCKDGKCECSPGWEGDHCTIAHYLDAIGSELQAGLAQTPKSQQLTLSPRRVRP

SEQ ID NO: 849026 - protein, 2732 aa, Homo sapiens
MEQTDCKPYQPLPKVKHEMDLAYTSSSDESEDGRKPRQSYNSRETLHEYNQELRMNYNSQSRKRKEVEKSTQEMEFCETSHTLCSGYQTDMHSVSRHGYQLEMGSDVDTETEGAASPDHALRMWIRGMKSEHSSCLSSRANSALSLTDTDHERKSDGENGFKFSPVCCDMEAQAGSTQDVQSSPHNQFTFRPLPPPPPPPHACTCARKPPPAADSLQRRSMTTRSQPSPAAPAPPTSTQDSVHLHNSWVLNSNIPLETRHSLFKHGSGSSAIFSAASQNYPLTSNTVYSPPPRPLPRSTFSRPAFTFNKPYRCCNWKCTALSATAITVTLALLLAYVIAVHLFGLTWQLQPVEGELYANGVSKGNRGTESMDTTYSPIGGKVSDKSEKKVFQKGRAIDTGEVDIGAQVMQTIPPGLFWRFQITIHHPIYLKFNISLAKDSLLGIYGRRNIPPTHTQFDFVKLMDGKQLVKQDSKGSDDTQHSPRNLILTSLQETGFIEYMDQGPWYLAFYNDGKKMEQVFVLTTAIEIMDDCSTNCNGNGECISGHCHCFPGFLGPDCARDSCPVLCGGNGEYEKGHCVCRHGWKGPECDVPEEQCIDPTCFGHGTCIMGVCICVPGYKGEICEEEDCLDPMCSNHGICVKGECHCSTGWGGVNCETPLPVCQEQCSGHGTFLLDAGVCSCDPKWTGSDCSTELCTMECGSHGVCSRGICQCEEGWVGPTCEERSCHSHCTEHGQCKDGKCECSPGWEGDHCTIAHYLDAVRDGCPGLCFGNGRCTLDQNGWHCVCQVGWSGTGCNVVMEMLCGDNLDNDGDGLTDCVDPDCCQQSNCYISPLCQGSPDPLDLIQQSQTLFSQHTSRLFYDRIKFLIGKDSTHVIPPEVSFDSRRACVIRGQVVAIDGTPLVGVNVSFLHHSDYGFTISRQDGSFDLVAIGGISVILIFDRSPFLPEKRTLWLPWNQFIVVEKVTMQRVVSDPPSCDISNFISPNPIVLPSPLTSFGGSCPERGTIVPELQVVQEEIPIPSSFVRLSYLSSRTPGYKTLLRILLTHSTIPVGMIKVHLTVAVEGRLTQKWFPAAINLVYTFAWNKTDIYGQKVWGLAEALVSVGYEYETCPDFILWEQRTVVLQGFEMDASNLGDWSLNKHHILNPQSGIIHKGNGENMFISQQPPVISTIMGNGHQRSVACTNCNGPAHNNKLFAPVALASGPDGSVYVGDFNFVRRIFPSGNSVSILELRNRDTRHSTSPAHKYYLAMDPVSESLYLSDTNTRKVYKLKSLVETKDLSKNFEVVAGTGDQCLPFDQSHCGDGGRASEASLNSPRGITVDRHGFIYFVDGTMIRKIDENAVITTVIGSNGLTSTQPLSCDSGMDITQVRLEWPTDLAVNPMDNSLYVLDNNIVLQISENRRVRIIAGRPIHCQVPGIDHFLVSKVAIHSTLESARAISVSHSGLLFIAETDERKVNRIQQVTTNGEIYIIAGAPTDCDCKIDPNCDCFSGDGGYAKDAKMKAPSSLAVSPDGTLYVADLGNVRIRTISRNQAHLNDMNIYEIASPADQELYQFTVNGTHLHTLNLITRDYVYNFTYNSEGDLGAITSSNGNSVHIRRDAGGMPLWLVVPGGQVYWLTISSNGVLKRVSAQGYNPALMTYPGNTGLLATKSNENGWTTVYEYDPEGHLTNATFPTGEVSSFHSDLEKLTKVELDTSNRENVLMSTNLTATSTIYILKQENTQSTYRVNPDGSLRVTFASGMEIGLSSEPHILAGAVNPTLGKCNISLPGEHNANLIEWRQRKEQNKGNVSAFERRLRAHNRNLLSIDFDHITRTGKIYDDHRKFTLRILYDQTGRPILWSPVSRYNEVNITYSPSGLVTFIQRGTWNEKMEYDQSGKIISRTWADGKIWSYTYLEKSVMLLLHSQRRYIFEYDQSDCLLSVTMPSMVRHSLQTMLSVGYYRNIYTPPDSSTSFIQDYSRDGRLLQTLHLGTGRRVLYKYTKQARLSEVLYDTTQVTLTYEESSGVIKTIHLMHDGFICTIRYRQTGPLIGRQIFRFSEEGLVNARFDYSYNNFRVTSMQAVINETPLPIDLYRYVDVSGRTEQFGKFSVINYDLNQVITTTVMKHTKIFSANGQVIEVQYEILKAIAYWMTIQYDNVGRMVICDIRVGVDANITRYFYEYDADGQLQTVSVNDKTQWRYSYDLNGNINLLSHGKSARLTPLRYDLRDRITRLGEIQYKMDEDGFLRQRGNDIFEYNSNGLLQKAYNKASGWTVQYYYDGLGRRVASKSSLGQHLQFFYADLTNPIRVTHLYNHTSSEITSLYYDLQGHLIAMELSSGEEYYVACDNTGTPLAVFSSRGQVIKEILYTPYGDIYHDTYPDFQVIIGFHGGLYDFLTKLVHLGQRDYDVVAGRWTTPNHHIWKQLNLLPKPFNLYSFENNYPVGKIQDVAKYTTDIRSWLELFGFQLHNVLPGFPKPELENLELTYELLRLQTKTQEWDPGKTILGIQCELQKQLRNFISLDQLPMTPRYNDGRCLEGGKQPRFAAVPSVFGKGIKFAIKDGIVTADIIGVANEDSRRLAAILNNAHYLENLHFTIEGRDTHYFIKLGSLEEDLVLIGNTGGRRILENGVNVTVSQMTSLLNGRTRRFADIQLQHGALCFNIRYGTTVEEEKNHVLEIARQRAVAQAWTKEQRRLQEGEEGIRAWTEGEKQQLLSTGRVQGYDGYFVLSVEQYLELSDSANNIHFMRQSEIGRR

SEQ ID NO: 849027 - protein, 1004 aa, Homo sapiens
MWEKMETKTIVYDLDTSGGLMEQIQALLAPPKTDEAEKRSRKPEKEPRRSGRATNHDSCDSCKEGGDLLCCDHCPAAFHLQCCNPPLSEEMLPPGEWMCHRCTVRRKKREQKKELGHVNGLVDKSGKRTTSPSSDTDLLDRSASKTELKAIAHARILERRASRPGTPTSSASTETPTSEQNDVDEDIIDVDEEPVAAEPDYVQPQLRRPFELLIAAAMERNPTQFQLPNELTCTTALPGSSKRRRKEETTGKNVKKTQHELDHNGLVPLPVKVCFTCNRSCRVAPLIQCDYCPLLFHMDCLEPPLTAMPLGRWMCPNHIEHVVLNQKNMTLSNRCQVFDRFQDTVSQHVVKVDFLNRIHKKHPPNRRVLQSVKRRSLKVPDAIKSQYQFPPPLIAPAAIRDGELICNGIPEESQMHLLNSEHLATQAEQQEWLCSVVALQCSILKHLSAKQMPSHWDSEQTEKADIKPVIVTDSSVTTSLQTADKTPTPSHYPLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSDGKVSPGTLSIGSALTVPSFPANSTAMVDLTNSLRAFMDVNGEIEINMLDEKLIKFLALQRIHQLFPSRVQPSPGSVGTHQLASGGHHIEVQRKEVQARAVFYPLLGLGGAVNMCYRTLYIGTGADMDVCLTNYGHCNYVSGKHACIFYDENTKHYELLNYSEHGTTVDNVLYSCDFSEKTPPTPPSSIVAKVQSVIRRRRHQKQDEEPSEEAAMMSSQAQGPQRRPCNCKASSSSLIGGSGAGWEGTALLHHGSYIKLGCLQFVFSITEFATKQPKGDASLLQDGVLAEKLSLKPHQGPVLRSNSVP

SEQ ID NO: 849028 - protein, 1019 aa, Homo sapiens
SVGLMEQIQALLAPPKTDEAEKRSRKPEKEPRRSGRATNHDSCDSCKEGGDLLCCDHCPAAFHLQCCNPPLSEEMLPPGEWMCHRCTVRRKPWNHPTLPMVTVWNPVGPKNPNMELLKWAEEKREQKKELGHVNGLVDKSGKRTTSPSSDTDLLDRSASKTELKAIAHARILERRASRPGTPTSSASTETPTSEQNDVDEDIIDVDEEPVAAEPDYVQPQLRRPFELLIAAAMERNPTQFQLPNELTCTTALPGSSKRRRKEETTGKNVKKTQHELDHNGLVPLPVKVCFTCNRSCRVAPLIQCDYCPLLFHMDCLEPPLTAMPLGRWMCPNHIEHVVLNQKNMTLSNRCQVFDRFQDTVSQHVVKVDFLNRIHKKHPPNRRVLQSVKRRSLKVPDAIKSQYQFPPPLIAPAAIRDGELICNGIPEESQMHLLNSEHLATQAEQQEWLCSVVALQCSILKHLSAKQMPSHWDSEQTEKADIKPVIVTDSSVTTSLQTADKTPTPSHYPLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSDGKVSPGTLSIGSALTVPSFPANSTAMVDLTNSLRAFMDVNGEIEINMLDEKLIKFLALQRIHQLFPSRVQPSPGSVGTHQLASGGHHIEVQRKEVQARAVFYPLLGLGGAVNMCYRTLYIGTGADMDVCLTNYGHCNYVSGKHACIFYDENTKHYELLNYSEHGTTVDNVLYSCDFSEKTPPTPPSSIVAKVQSVIRRRRHQKQDEEPSEEAAMMSSQAQGPQRRPCNCKASSSSLIGGSGAGWEGTALLHHGSYIKLGCLQFVFSITEFATKQPKGDASLLQDGVLAEKLSLKPHQGPVLRSNSVP

SEQ ID NO: 849029 - protein, 707 aa, Homo sapiens
MDCLEPPLTAMPLGRWMCPNHIEHVVLNQKNMTLSNRCQVFDRFQDTVSQHVVKVDFLNRIHKKHPPNRRVLQSVKRRSLKVPDAIKSQYQFPPPLIAPAAIRDGELICNGIPEESQMHLLNSEHLATQAEQQEWLCSVVALQCSILKHLSAKQMPSHWDSEQTEKADIKPVIVTDSSVTTSLQTADKTPTPSHYPLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSDGKVSPGTLSIGSALTVPSFPANSTAMVDLTNSLRAFMDVNGEIEINMLDEKLIKFLALQRIHQLFPSRVQPSPGSVGTHQLASGGHHIEVQRKEVQARAVFYPLLGLGGAVNMCYRTLYIGTGADMDVCLTNYGHCNYVSGKHACIFYDENTKHYELLNYSEHGTTVDNVLYSCDFSEKTPPTPPSSIVAKVQSVIRRRRHQKQDEEPSEEAAMMSSQAQGPQRRPCNCKASSSSLIGGSGAGWEGTALLHHGSYIKLGCLQFVFSITEFATKQPKGDASLLQDGVLAEKLSLKPHQGPVLRSNSVP

SEQ ID NO: 849030 - protein, 708 aa, Homo sapiens
REFVLVLREFVLVLREFVLVLREFVLVLNQKNMTLSNRCQVFDRFQDTVSQHVVKVDFLNRIHKKHPPNRRVLQSVKRRSLKVPDAIKSQYQFPPPLIAPAAIRDGELICNGIPEESQMHLLNSEHLATQAEQQEWLCSVVALQCSILKHLSAKQMPSHWDSEQTEKADIKPVIVTDSSVTTSLQTADKTPTPSHYPLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSDGKVSPGTLSIGSALTVPSFPANSTAMVDLTNSLRAFMDVNGEIEINMLDEKLIKFLALQRIHQLFPSRVQPSPGSVGTHQLASGGHHIEVQRKEVQARAVFYPLLGLGGAVNMCYRTLYIGTGADMDVCLTNYGHCNYVSGKHACIFYDENTKHYELLNYSEHGTTVDNVLYSCDFSEKTPPTPPSSIVAKVQSVIRRRRHQKQDEEPSEEAAMMSSQAQGPQRRPCNCKASSSSLIGGSGAGWEGTALLHHGSYIKLGCLQFVFSITEFATKQPKGDASLLQDGVLAEKLSLKPHQGPVLRSNSVP

SEQ ID NO: 849031 - protein, 972 aa, Homo sapiens
MWEKMETKTIVYDLDTSGGLMEQIQALLAPPKTDEAEKRSRKPEKEPRRSGRATNHDSCDSCKEGGDLLCCDHCPAAFHLQCCNPPLSEEMLPPGEWMCHRCTVRRKKREQKKELGHVNGLVDKSGKRTTSPSSDTDLLDRSASKTELKAIAHARILERRASRPGTPTSSASTETPTSEQNDVDEDIIDVDEEPVAAEPDYVQPQLRRPFELLIAAAMERNPTQFQLPNELTCTTALPGSSKRRRKEETTGKNVKKTQHELDHNGLVPLPVKVCFTCNRSCRVAPLIQCDYCPLLFHMDCLEPPLTAMPLGRWMCPNHIEHVVLNQKNMTLSNRCQVFDRFQDTVSQHVVKVDFLNRIHKKHPPNRRVLQSVKRRSLKVPDAIKSQYQFPPPLIAPAAIRDGELICNGIPEESQMHLLNSEHLATQAEQQEWLCSVVALQCSILKHLSAKQMPSHWDSEQTEKADIKPVIVTDSSVTTSLQTADKTPTPSHYPLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSANSTAMVDLTNSLRAFMDVNGEIEINMLDEKLIKFLALQRIHQLFPSRVQPSPGSVGTHQLASGGHHIEVQRKEVQARAVFYPLLGLGGAVNMCYRTLYIVDSHCNYVSGKHACIFYDENTKHYELLNYSEHGTTVDNVLYSCDFSEKTPPTPPSSIVAKVQSVIRRRRHQKQDEEPSEEAAMMSSQAQGPQRRPCNCKASSSSLIGGSGAGWEGTALLHHGSYIKLGCLQFVFSITEFATKQPKGDASLLQDGVLAEKLSLKPHQGPVLRSNSVP

SEQ ID NO: 849032 - protein, 549 aa, Homo sapiens
MLSYDREPSIYTCCVNEDLRVTTSLQTADKTPTPSHYPLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSDGKVSPGTLSIGSALTVPSFPANSTAMVDLTNSLRAFMDVNGEIEINMLDEKLIKFLALQRIHQLFPSRVQPSPGSVGTHQLASGGHHIEVQRKEVQARAVFYPLLGLGGAVNMCYRTLYIGTGADMDVCLTNYGHCNYVSGKHACIFYDENTKHYELLNYSEHGTTVDNVLYSCDFSEKTPPTPPSSIVAKVQSVIRRRRHQKQDEEPSEEAAMMSSQAQGPQRRPCNCKASSSSLIGGSGAGWEGTALLHHGSYIKLGCLQFVFSITEFATKQPKGDASLLQDGVLAEKLSLKPHQGPVLRSNSVP

SEQ ID NO: 849033 - protein, 533 aa, Homo sapiens
YGISRAAVEVWAIAFTSVITGPLGVPQGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSDGKVSPGTLSIGSALTVPSFPANSTAMVDLTNSLRAFMDVNGEIEINMLDEKLIKFLALQRIHQLFPSRVQPSPGSVGTHQLASGGHHIEVQRKEVQARAVFYPLLGLGGAVNMCYRTLYIGTGADMDVCLTNYGHCNYVSGKHACIFYDENTKHYELLNYSEHGTTVDNVLYSCDFSEKTPPTPPSSIVAKVQSVIRRRRHQKQDEEPSEEAAMMSSQAQGPQRRPCNCKASSSSLIGGSGAGWEGTALLHHGSYIKLGCLQFVFSITEFATKQPKGDASLLQDGVLAEKLSLKPHQGPVLRSNSVP

SEQ ID NO: 849034 - protein, 169 aa, Homo sapiens
MAGHLISPPPPQNTKHYELLNYSEHGTTVDNVLYSCDFSEKTPPTPPSSIVAKVQSVIRRRRHQKQDEEPSEEAAMMSSQAQGPQRRPCNCKASSSSLIGGSGAGWEGTALLHHGSYIKLGCLQFVFSITEFATKQPKGDASLLQDGVLAEKLSLKPHQGPVLRSNSVP

SEQ ID NO: 849035 - protein, 116 aa, Homo sapiens
SVGLMEQIQALLAPPKTDEAEKRSRKPEKEPRRSGRATNHDSCDSCKEGGDLLCCDHCPAAFHLQCCNPPLSEEMLPPGEWMCHRCTVRRKPWNHPTLPMVTVWNPVGPKNPNMGC

SEQ ID NO: 849036 - protein, 704 aa, Homo sapiens
MWEKMETKTIVYDLDTSGGLMEQIQALLAPPKTDEAEKRSRKPEKEPRRSGRATNHDSCDSCKEGGDLLCCDHCPAAFHLQCCNPPLSEEMLPPGEWMCHRCTVRRKKREQKKELGHVNGLVDKSGKRTTSPSSDTDLLDRSASKTELKAIAHARILERRASRPGTPTSSASTETPTSEQNDVDEDIIDVDEEPVAAEPDYVQPQLRRPFELLIAAAMERNPTQFQLPNELTCTTALPGSSKRRRKEETTGKNVKKTQHELDHNGLVPLPVKVCFTCNRSCRVAPLIQCDYCPLLFHMDCLEPPLTAMPLGRWMCPNHIEHVVLNQKNMTLSNRCQVFDRFQDTVSQHVVKVDFLNRIHKKHPPNRRVLQSVKRRSLKVPDAIKSQYQFPPPLIAPAAIRDGELICNGIPEESQMHLLNSEHLATQAEQQEWLCSVVALQCSILKHLSAKQMPSHWDSEQTEKADIKPVIVTDSSVTTSLQTADKTPTPSHYPLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSGECCSALG

SEQ ID NO: 849037 - protein, 707 aa, Homo sapiens; identical to SEQ ID NO: 849029

SEQ ID NO: 849038 - protein, 590 aa, Homo sapiens
MHLLNSEHLATQAEQQEWLCSVVALQCSILKHLSAKQMPSHWDSEQTEKADIKPVIVTDSSVTTSLQTADKTPTPSHYPLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSDGKVSPGTLSIGSALTVPSFPANSTAMVDLTNSLRAFMDVNGEIEINMLDEKLIKFLALQRIHQLFPSRVQPSPGSVGTHQLASGGHHIEVQRKEVQARAVFYPLLGLGGAVNMCYRTLYIGTGADMDVCLTNYGHCNYVSGKHACIFYDENTKHYELLNYSEHGTTVDNVLYSCDFSEKTPPTPPSSIVAKVQSVIRRRRHQKQDEEPSEEAAMMSSQAQGPQRRPCNCKASSSSLIGGSGAGWEGTALLHHGSYIKLGCLQFVFSITEFATKQPKGDASLLQDGVLAEKLSLKPHQGPVLRSNSVP

SEQ ID NO: 849039 - protein, 993 aa, Homo sapiens
MWEKMETKTIVYDLDTSGGLMEQIQALLAPPKTDEAEKRSRKPEKEPRRSGRATNHDSCDSCKEGGDLLCCDHCPAAFHLQCCNPPLSEEMLPPGEWMCHRCTVRRKKREQKKELGHVNGLVDKSGKRTTSPSSDTDLLDRSASKTELKAIAHARILERRASRPGTPTSSASTETPTSEQNDVDEDIIDVDEEPVAAEPDYVQPQLRRPFELLIAAAMERNPTQFQLPNELTCTTALPGSSKRRRKEETTGKNVKKTQHELDHNGLVPLPVKVCFTCNRSCRVAPLIQCDYCPLLFHMDCLEPPLTAMPLGRWMCPNHIEHVVLNQKNMTLSNRCQVFDRFQDTVSQHVVKVDFLNRIHKKHPPNRRVLQSVKRRSLKVPDAIKSQYQFPPPLIAPAAIRDGELICNGIPEESQMHLLNSEHLATQAEQQEWLCSVVALQCSILKHLSAKQMPSHWDSEQTEKADIKPVIVTDSSVTTSLQTADKTPTPSHYPLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSDGKVSPGTLSIGSALTVPSFPANSTAMVDLTNSLRAFMDVNGEIEINMLDEKLIKFLALQRIHQLFPSRVQPSPGSVGTHQLASGGHHIEVQRKEVQARAVFYPLLGLGGAVNMCYRTLYIVDSHCNYVSGKHACIFYDENTKHYELLNYSEHGTTVDNVLYSCDFSEKTPPTPPSSIVAKVQSVIRRRRHQKQDEEPSEEAAMMSSQAQGPQRRPCNCKASSSSLIGGSGAGWEGTALLHHGSYIKLGCLQFVFSITEFATKQPKGDASLLQDGVLAEKLSLKPHQGPVLRSNSVP

SEQ ID NO: 849040 - protein, 612 aa, Homo sapiens
TKAGLGRPRGTGPYGRIPEESQMHLLNSEHLATQAEQQEWLCSVVALQCSILKHLSAKQMPSHWDSEQTEKADIKPVIVTDSSVTTSLQTADKTPTPSHYPLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSDGKVSPGTLSIGSALTVPSFPANSTAMVDLTNSLRAFMDVNGEIEINMLDEKLIKFLALQRIHQLFPSRVQPSPGSVGTHQLASGGHHIEVQRKEVQARAVFYPLLGLGGAVNMCYRTLYIGTGADMDVCLTNYGHCNYVSGKHACIFYDENTKHYELLNYSEHGTTVDNVLYSCDFSEKTPPTPPSSIVAKVQSVIRRRRHQKQDEEPSEEAAMMSSQAQGPQRRPCNCKASSSSLIGGSGAGWEGTALLHHGSYIKLGCLQFVFSITEFATKQPKGDASLLQDGVLAEKLSLKPHQGPVLRSNSVP

SEQ ID NO: 849041 - protein, 182 aa, Homo sapiens
MDVCLTNYGHCNYVSGKHACIFYDENTKHYELLNYSEHGTTVDNVLYSCDFSEKTPPTPPSSIVAKVQSVIRRRRHQKQDEEPSEEAAMMSSQAQGPQRRPCNCKASSSSLIGGSGAGWEGTALLHHGSYIKLGCLQFVFSITEFATKQPKGDASLLQDGVLAEKLSLKPHQGPVLRSNSVP

SEQ ID NO: 849042 - protein, 116 aa, Homo sapiens; identical to SEQ ID NO: 849035

SEQ ID NO: 849043 - protein, 159 aa, Homo sapiens
MKNHLLFWGVLAVFIKAVHVKAQEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYGGETKMVETALTPDACYPD

SEQ ID NO: 849044 - protein, 159 aa, Homo sapiens; identical to SEQ ID NO: 849043

SEQ ID NO: 849045 - protein, 176 aa, Homo sapiens
FLKQTEVDDEEPMCCDSVELLVGPNKKCWSCDKAYRNDHTDCHCRQSKCNVCARITFLGILRSSEDPYLRTSWTESILNYVPLNNRENISDPTSPLRTRFVYHLSDLCKKCDPTEVELDNQIVTATQSNICDEDSATETCYTYDRNKCYTAVVPLVYGGETKMVETALTPDACYPD

SEQ ID NO: 849046 - protein, 104 aa, Homo sapiens
MDVEDLCITILIHGVIDEVCYTLMIHEPVWRMVIAYSERWSPDVITIVIAGTTIQYVVPEERAIRGYCYTYDRNKCYTAVVPLVYGGETKMVETALTPDACYPD

SEQ ID NO: 849047 - protein, 159 aa, Homo sapiens; identical to SEQ ID NO: 849043

SEQ ID NO: 849048 - protein, 159 aa, Homo sapiens; identical to SEQ ID NO: 849043

SEQ ID NO: 849049 - protein, 130 aa, Homo sapiens
MKNHLLFWGVLAVFIKAVHVKAQEDERIVLVDNKCKCARITSRIIRSSEDPNEDIVERNIRIIVPLNNRENISDPTSPLRTRFVYHLSDLAISVMKTVLQRPATLMTETSATQLWSHSYMVVRPKWWKQP

SEQ ID NO: 849050 - protein, 69 aa, Homo sapiens
MKNHLLFWGVLAVFIKAVHVKAQEDERIVLVDNKCKCARITSRIIRSSEDPNEDIVERNIRIMYVAFHI

SEQ ID NO: 849051 - protein, 477 aa, Homo sapiens
MGRTVVVLGGGISGLAASYHLSRAPCPPKVVLVESSERLGGWIRSVRGPNGAIFELGPRGIRPAGALGARTLLLVSELGLDSEVLPVRGDHPAAQNRFLYVGGALHALPTGLRGLLRPSPPFSKPLFWAGLRELTKPRGKEPDETVHSFAQRRLGPEVASLAMDSLCRGVFAGNSRELSIRSCFPSLFQAEQTHRSILLGLLLGAGRTPQPDSALIRQALAERWSQWSLRGGLEMLPQALETHLTSRGVSVLRGQPVCGLSLQAEGRWKVSLRDSSLEADHVISAIPASVLSELLPAEAAPLARALSAITAVSVAVVNLQYQGAHLPVQGFGHLVPSSEDPGVLGIVYDSVAFPEQDGSPPGLRVTVMLGGSWLQTLEASGCVLSQELFQQRAQEAAATQLGLKEMPSHCLVHLHKNCIPQYTLGHWQKLESARQFLTAHRLPLTLAGASYEGVAVNDCIESGRQAAVSVLGTEPNS

SEQ ID NO: 849052 - protein, 477 aa, Homo sapiens; identical to SEQ ID NO: 849051

SEQ ID NO: 849053 - protein, 133 aa, Homo sapiens
MTGPWSGLRSTQGEVGNRLLLFFMCLGANSSGAGTVTTWGLPPCRRIPSAHTWSFAACRHRHPNSRAGIAAAILEAGAAGAGSRVMGRGLGAEPPGLTRHPVPDTAWPGACEGAAPEPAHLERVVGDPLGSGC

SEQ ID NO: 849054 - protein, 188 aa, Homo sapiens
MGRTVVVLGGGISGLAASYHLSRAPCPPKVVLVESSERLGGWIRSVRGPNGAIFELGPRGIRPAGALGARTLLLVMLGGSWLQTLEASGCVLSQELFQQRAQEAAATQLGLKEMPSHCLVHLHKTKNQLKWRQSHDRTVEWPKEYPGRSRKQAPSILHVPGCQLLRCRDRDHLGAVSEQPRSSAESRV

SEQ ID NO: 849055 - protein, 440 aa, Homo sapiens
MSRRGCGGGFHWGIEFRGGSMFGGSDLPLVSPLLRACVSELGLDSEVLPVRGDHPAAQNRFLYVGGALHALPTGLRGLLRPSPPFSKPLFWAGLRELTKPRGKEPDETVHSFAQRRLGPEVASLAMDSLCRGVFAGNSRELSIRSCFPSLFQAEQTHRSILLGLLLGAGRTPQPDSALIRQALAERWSQWSLRGGLEMLPQALETHLTSRGVSVLRGQPVCGLSLQAEGRWKVSLRDSSLEADHVISAIPASVLSELLPAEAAPLARALSAITAVSVAVVNLQYQGAHLPVQGFGHLVPSSEDPGVLGIVYDSVAFPEQDGSPPGLRVTVMLGGSWLQTLEASGCVLSQELFQQRAQEAAATQLGLKEMPSHCLVHLHKNCIPQYTLGHWQKLESARQFLTAHRLPLTLAGASYEGVAVNDCIESGRQAAVSVLGTEPNS

SEQ ID NO: 849056 - protein, 409 aa, Homo sapiens
MDGDLAVSELGLDSEVLPVRGDHPAAQNRFLYVGGALHALPTGLRGLLRPSPPFSKPLFWAGLRELTKPRGKEPDETVHSFAQRRLGPEVASLAMDSLCRGVFAGNSRELSIRSCFPSLFQAEQTHRSILLGLLLGAGRTPQPDSALIRQALAERWSQWSLRGGLEMLPQALETHLTSRGVSVLRGQPVCGLSLQAEGRWKVSLRDSSLEADHVISAIPASVLSELLPAEAAPLARALSAITAVSVAVVNLQYQGAHLPVQGFGHLVPSSEDPGVLGIVYDSVAFPEQDGSPPGLRVTVMLGGSWLQTLEASGCVLSQELFQQRAQEAAATQLGLKEMPSHCLVHLHKNCIPQYTLGHWQKLESARQFLTAHRLPLTLAGASYEGVAVNDCIESGRQAAVSVLGTEPNS

SEQ ID NO: 849057 - protein, 315 aa, Homo sapiens
MDSLCRGVFAGNSRELSIRSCFPSLFQAEQTHRSILLGLLLGAGRTPQPDSALIRQALAERWSQWSLRGGLEMLPQALETHLTSRGVSVLRGQPVCGLSLQAEGRWKVSLRDSSLEADHVISAIPASVLSELLPAEAAPLARALSAITAVSVAVVNLQYQGAHLPVQGFGHLVPSSEDPGVLGIVYDSVAFPEQDGSPPGLRVTVMLGGSWLQTLEASGCVLSQELFQQRAQEAAATQLGLKEMPSHCLVHLHKNCIPQYTLGHWQKLESARQFLTAHRLPLTLAGASYEGVAVNDCIESGRQAAVSVLGTEPNS

SEQ ID NO: 849058 - protein, 308 aa, Homo sapiens
MGRTVVVLGGGISGLAASYHLSRAPCPPKVVLVESSERLGGWIRSVRGPNGAIFELGPRGIRPAGALGARTLLLVSELGLDSEVLPVRGDHPAAQNRFLYVGGALHALPTGLRGLLRPSPPFSKPLFWAGLRELTKPRGKEPDETVHSFAQRRLGPEVASLAMDSLCRGVFAGNSRELSIRSCFPSLFQAEQTHRSILLGLLLGAGRTPQPDSALIRQALAERWSQWSLRGGLEMLPQALETHLTSRGVSVLRGQPVCGLSLQAEGRWKVSLRDSSLEADHVISAIPASGIWTFGAIFRRSRSPGNRV

SEQ ID NO: 849059 - protein, 238 aa, Homo sapiens
MGRTVVVLGGGISGLAASYHLSRAPCPPKVVLVESSERLGGWIRSVRGPNGAIFELGPRGIRPAGALGARTLLLVSELGLDSEVLPVRGDHPAAQNRFLYVGGALHALPTGLRGLLRPSPPFSKPLFWAGLRELTKPRGKEPDETVHSFAQRRLGPEVASLAMDSLCRGVFAGNSRELSIRSCFPSLFQAEQTHRSILLGLLLGAGEGGLIQRVKILSTAKVREWGQGVLFNDSFFLF

SEQ ID NO: 849060 - protein, 140 aa, Homo sapiens
MGRTVVVLGGGISGLAASYHLSRAPCPPKVMLGGSWLQTLEASGCVLSQELFQQRAQEAAATQLGLKEMPSHCLVHLHKNCIPQYTLGHWQKLESARQFLTAHRLPLTLAGASYEGVAVNDCIESGRQAAVSVLGTEPNS

SEQ ID NO: 849061 - protein, 209 aa, Homo sapiens
MVSLRDSSLEADHVISAIPASVLSELLPAEAAPLARALSAITAVSVAVVNLQYQGAHLPVQGFGHLVPSSEDPGVLGIVYDSVAFPEQDGSPPGLRVTVMLGGSWLQTLEASGCVLSQELFQQRAQEAAATQLGLKEMPSHCLVHLHKNCIPQYTLGHWQKLESARQFLTAHRLPLTLAGASYEGVAVNDCIESGRQAAVSVLGTEPNS

SEQ ID NO: 849062 - protein, 182 aa, Homo sapiens [sequence omitted]

SEQ ID NO: 849063 - protein, 477 aa, Homo sapiens; identical to SEQ ID NO: 849051

SEQ ID NO: 849064 - protein, 592 aa, Homo sapiens
MGRTVVVLGGGISGLAASYHLSRAPCPPKVVLVESSERLGGWIRSVRGPNGAIFELGPRGIRPAGALGARTLLLVSELGLDSEVLPVRGDHPAAQNRFLYVGGALHALPTGLRGLLRPSPPFSKPLFWAGLRELTKPRGKEPDETVHSFAQRRLGPEVASLAMDSLCRGVFAGNSRELSIRSCFPSLFQAEQTHRSILLGLLLGAGRTPQPDSALIRQALAERWSQWSLRGGLEMLPQALETHLTSRGVSVLRGQPVCGLSLQAEGRWKVSLRDSSLEADHVISAIPASVLSELLPAEAAPLARALSAITAVSVAVVNLQYQGAHLPVQGFGHLVPSSEDPGVLGIVYDSVAFPEQDGSPPGLRVTVRRRKLCLVAFPEGSSVLHCRQGQTDQCYIPSLVMLGGSWLQTLEASGCVLSQELFQQRAQEAAATQLGLKEMPSHCLVHLHKTKNQLKWRQSHDRTVEWPKEYQGEVGNRLLLFFMCLGANSSGAGTVTTWGLPPCRRIPSAHTWSFAACRHRHPNSRAGIAAAILEAGAAGAGSRVMGRGLGAEPPGLTRHPVPDTAWPGACEGAAPEPAHLERVVGDPLGSGC

SEQ ID NO: 849065 - protein, 449 aa, Homo sapiens
MGRTVVVLGGGISGLAASYHLSRAPCPPKVVLVESSERLGGWIRSVRGPNGAIFELGPRGIRPAGALGARTLLLVSELGLDSEVLPVRGDHPAAQNRFLYVGGALHALPTGLRGLLRPSPPFSKPLFWAGLRELTKPRGKEPDETVHSFAQRRLGPEVASLAMDSLCRGVFAGNSRELSIRSCFPSLFQAEQTHRSILLGLLLGAGRTPQPDSALIRQALAERWSQWSLRGGLEMLPQALETHLTSRGVSVLRGQPVCGLSLQAEGRWKVSLRDSSLEADHVISAIPASVLSELLPAEAAPLARALSAITAVSVAVVNLQYQGAHLPVQGFGHLVPSSEDPGVLGIVYDSVAFPEQDGSPPGLRVTVMLGGSWLQTLEASGCVLSQELFQQRAQEAAATQLGLKEMPSHCLVHLHKNCIPQYTLGHWQKLEVSWENSWAEEGQGHQTPS

SEQ ID NO: 849066 - protein, 113 aa, Homo sapiens
MGRTVVVLGGGISGLAASYHLSRAPCPPKVVLVESSERLGGWIRSVRGPNGAIFELGPRGIRPAGALGARTLLLVSLRDSSLEADHVISAIPASGIWTFGAIFRRSRSPGNRV

SEQ ID NO: 849067 - protein, 185 aa, Homo sapiens
MGRTVVVLGGGISGLAASYHLSRAPCPPKVVLVESSERLGGWIRSVRGPNGAIFELGPRGIRPAGALGARTLLLVMLGGSWLQTLEASGCVLSQELFQQRAQEAAATQLGLKEMPSHCLVHLHKNCIPQYTLGHWQKLESARQFLTAHRLPLTLAGASYEGVAVNDCIESGRQAAVSVLGTEPNS

SEQ ID NO: 849068 - protein, 145 aa, Homo sapiens
MSRRGCGGGFHWGIEFRGGSMFGGSDLPLVSPLLRACVSELGLDSEVLPVRGDHPAAQNRFLYVGGALHALPTGLRGLLRPSPPFSKPLFWAGLRELTKPRGKEPDETVHSFAQRRLGPEVTLAQRPQTSSLLNQLQSSLFKSTT

SEQ ID NO: 849069 - protein, 32 aa, Homo sapiens
MGDRKMPLFTEGESRKTTVYGKARVRIWSHDI

SEQ ID NO: 849070 - protein, 339 aa, Homo sapiens
MDLGECLKVHDLALRADYEIASKEQDFFFELDAMDHLQSFIADCDRRTEVAKKRLAETQEEISAEVAAKAERVHELNEEIGKLLAKVEQLGAEGNVEESQKVMDEVEKARAKKREAEEVYRNSMPASSFQQQKLRVCEVCSAYLGLHDNDRRLADHFGGKLHLGFIEIREKLEELKRVVAEKQEKRNQERLKRREEREREEREKLRRSRSHSKNPKRSRSREHRRHRSRSMSRERKRRTRSKSREKRHRHRSRSSSRSRSRSHQRSRHSSRDRSRERSKRRSSKERFRDQDLASCDRDRSSRDRSPRDRDRKDKKRSYESANGRSEDRRSSEEREAGEI

SEQ ID NO: 849071 - protein, 389 aa, Homo sapiens
PTSICKGVSERPRIRQAGDTTRQRIKFSDDRVCKSHLLNCCPHDVLSGTRMDLGECLKVHDLALRADYEIASKEQDFFFELDAMDHLQSFIADCDRRTEVAKKRLAETQEEISAEVAAKAERVHELNEEIGKLLAKVEQLGAEGNVEESQKVMDEVEKARAKKREAEEVYRNSMPASSFQQQKLRVCEVCSAYLGLHDNDRRLADHFGGKLHLGFIEIREKLEELKRVVAEKQEKRNQERLKRREEREREEREKLRRSRSHSKNPKRSRSREHRRHRSRSMSRERKRRTRSKSREKRHRHRSRSSSRSRSRSHQRSRHSSRDRSRERSKRRSSKERFRDQDLASCDRDRSSRDRSPRDRDRKDKKRSYESANGRSEDRRSSEEREAGEI

SEQ ID NO: 849072 - protein, 368 aa, Homo sapiens
VAHLTSPPDRVCKSHLLNCCPHDVLSGTRMDLGECLKVHDLALRADYEIASKEQDFFFELDAMDHLQSFIADCDRRTEVAKKRLAETQEEISAEVAAKAERVHELNEEIGKLLAKVEQLGAEGNVEESQKVMDEVEKARAKKREAEEVYRNSMPASSFQQQKLRVCEVCSAYLGLHDNDRRLADHFGGKLHLGFIEIREKLEELKRVVAEKQEKRNQERLKRREEREREEREKLRRSRSHSKNPKRSRSREHRRHRSRSMSRERKRRTRSKSREKRHRHRSRSSSRSRSRSHQRSRHSSRDRSRERSKRRSSKERFRDQDLASCDRDRSSRDRSPRDRDRKDKKRSYESANGRSEDRRSSEEREAGEI

SEQ ID NO: 849073 - protein, 392 aa, Homo sapiens
MSAQAQMRAMLDQLMGTSRDGDTTRQRIKFSDDRVCKSHLLNCCPHDVLSGTRMDLGECLKVHDLALRADYEIASKEQDFFFELDAMDHLQSFIADCDRRTEVAKKRLAETQEEISAEVAAKAERVHELNEEIGKLLAKVEQLGAEGNVEESQKVMDEVEKARAKKREAEEVYRNSMPASSFQQQKLRVCEVCSAYLGLHDNDRRLADHFGGKLHLGFIEIREKLEELKRVVAEKQEKRNQERLKRREEREREEREKLRRSRSHSKNPKRSRSREHRRHRSRSMSRERKRRTRSKSREKRHRHRSRSSSRSRSRSHQRSRHSSRDRSRERSKRRSSKERFRDQDLASCDRDRSSRDRSPRDRDRKDKKRSYESANGRSEDRRSSEEREAGEI

SEQ ID NO: 849074 - protein, 335 aa, Homo sapiens
MSAQAQMRAMLDQLMGTSRDGDTTRQRIKFSDDRVCKSHLLNCCPHDVLSGTRMDLGECLKVHDLALRADYEIASKEQDFFFELDAMDHLQSFIADCDRRTEVAKKRLAETQEEISAEVAAKAERVHELNEEIGKLLAKVEQLGAEGNVEESQKVMDEVEKARAKKREAEEVYRNSMPASSFQQQKLRVCEVCSAYLGLHDNDRRLADHFGGKLHLGFIEIREKLEELKRVVAEKQEKRNQERLKRREEREREEREKLRRSRSHSKNPKRSRSREHRRHRSRSMSRERKRRTRSKSREKRHRHRSRSSSRSRSRSHQRSRHSSRDRSRERSKRRY

SEQ ID NO: 849075 - protein, 392 aa, Homo sapiens; identical to SEQ ID NO: 849073

SEQ ID NO: 849076 - protein, 335 aa, Homo sapiens; identical to SEQ ID NO: 849074

SEQ ID NO: 849077 - protein, 270 aa, Homo sapiens
MSAQAQMRAMLDQLMGTSRDGDTTRQRIKFSDDRVCKSHLLNCCPHDVLSGTRMDLGECLKVHDLALRADYEIASKEQDFFFELDAMDHLQSFIADCDRRTEVAKKRLAETQEEISAEVAAKAERVHELNEEIGKLLAKVEQLGAEGNVEESQKVMDEVEKARAKKREAEEVYRNSMPASSFQQQKLRVCEVCSAYLGLHDNDRRLADHFGGKLHLGFIEIREKLEELKRVVAEKQEKRNQERLKRREEREREEREKLRRSRSHSKNPKR

SEQ ID NO: 849078 - protein, 142 aa, Homo sapiens
MSAQAQMRAMLDQLMGTSRDGDTTRQRIKFSDDRVCKSHLLNCCPHDVLSGTRMDLGECLKVHDLALRADYEIASKEQDFFFELDAMDHLQSFIADCDRRTEVAKKRLAETQEEISAEVAAKAAPARRSQSSVPLPAQKQVH

SEQ ID NO: 849079 - protein, 392 aa, Homo sapiens; identical to SEQ ID NO: 849073

SEQ ID NO: 849080 - protein, 392 aa, Homo sapiens; identical to SEQ ID NO: 849073

SEQ ID NO: 849081 - protein, 339 aa, Homo sapiens; identical to SEQ ID NO: 849070

SEQ ID NO: 849082 - protein, 306 aa, Homo sapiens
MDHLQSFIADCDRRTEVAKKRLAETQEEISAEVAAKAERVHELNEEIGKLLAKVEQLGAEGNVEESQKVMDEVEKARAKKREAEEVYRNSMPASSFQQQKLRVCEVCSAYLGLHDNDRRLADHFGGKLHLGFIEIREKLEELKRVVAEKQEKRNQERLKRREEREREEREKLRRSRSHSKNPKRSRSREHRRHRSRSMSRERKRRTRSKSREKRHRHRSRSSSRSRSRSHQRSRHSSRDRSRERSKRRSSKERFRDQDLASCDRDRSSRDRSPRDRDRKDKKRSYESANGRSEDRRSSEEREAGEI

SEQ ID NO: 849083 - protein, 166 aa, Homo sapiens
ILAVITLPKREYPNQERLKRREEREREEREKLRRSRSHSKNPKRSRSREHRRHRSRSMSRERKRRTRSKSREKRHRHRSRSSSRSRSRSHQRSRHSSRDRSRERSKRRSSKERFRDQDLASCDRDRSSRDRSPRDRDRKDKKRSYESANGRSEDRRSSEEREAGEI

SEQ ID NO: 849084 - protein, 335 aa, Homo sapiens; identical to SEQ ID NO: 849074

SEQ ID NO: 849085 - protein, 105 aa, Homo sapiens
MGRRACFLGYCFRALSPEVDTSQPRSLKAPRSGRNAARRRRDRPAPAGKGAREPGRVHATRGGRSPRARPPQTPRRLTAVRSTMGMVSTYFPPRLTSSSILLIWV

SEQ ID NO: 849086 - protein, 186 aa, Homo sapiens
MSAQAQMRAMLDQLMGTSRDGDTTRQRIKFSDDRVCKSHLLNCCPHDVLSGTRMDLGECLKVHDLALRADYEIASKEQDFFFELDAMDHLQSFIADCDRRTEVAKKRLAETQEEISAEVAAKAERVHELNEEIGKLLAKVEQLGAEGNVEESQKVMDEVEKARAKKREAEEVIGIYASFSFNRRNL

SEQ ID NO: 849087 - protein, 633 aa, Homo sapiens
MAHLKRLVKLHIKRHYHKKFWKLGAVIFFFIIVLVLMQREVSVQYSKEESRMERNMKNKNKMLDLMLEAVNNIKDAMPKMQIGAPVRQNIDAGERPCLQGYYTAAELKPVLDRPPQDSNAPGASGKAFKTTNLSVEEQKEKERGEAKHCFNAFASDRISLHRDLGPDTRPPECIEQKFKRCPPLPTTSVIIVFHNEAWSTLLRTVHSVLYSSPAILLKEIILVDDASVDEYLHDKLDEYVKQFSIVKIVRQRERKGLITARLLGATVATAETLTFLDAHCECFYGWLEPLLARIAENYTAVVSPDIASIDLNTFEFNKPSPYGSNHNRGNFDWSLSFGWESLPDHEKQRRKDETYPIKTPTFAGGLFSISKEYFEYIGSYDEEMEIWGGENIEMSFRVWQCGGQLEIMPCSVVGHVFRSKSPHSFPKGTQVIARNQVRLAEVWMDEYKEIFYRRNTDAAKIVKQKAFGDLSKRFEIKHRLQCKNFTWYLNNIYPEVYVPDLNPVISGYIKSVGQPLCLDVGENNQGGKPLIMYTCHGLGGNQYFEYSAQHEIRHNIQKELCLHAAQGLVQLKACTYKGHKTVVTGEQIWEIQKDQLLYNPFLKMCLSANGEHPSLVSCNPSDPLQKWILSQND

SEQ ID NO: 849088 - protein, 633 aa, Homo sapiens; identical to SEQ ID NO: 849087

SEQ ID NO: 849089 - protein, 646 aa, Homo sapiens
MAHLKRLVKLHIKRHYHKKFWKLGAVIFFFIIVLVLMQREVSVQYSKEESRMERNMKNKNKMLDLMLEAVNNIKDAMPKMQIGAPVRQNIDAGERPCLQGYYTAAELKPVLDRPPQDSNAPGASGKAFKTTNLSVEEQKEKERGEAKHCFNAFASDRISLHRDLGPDTRPPECIEQKFKRCPPLPTTSVIIVFHNEAWSTLLRTVHSVLYSSPAILLKEIILVDDASVDEYLHDKLDEYVKQFSIVKIVRQRERKGLITARLLGATVATAETLTFLDAHSFSTGIIAMTAQAGECFYGWLEPLLARIAENYTAVVSPDIASIDLNTFEFNKPSPYGSNHNRGNFDWSLSFGWESLPDHEKQRRKDETYPIKTPTFAGGLFSISKEYFEYIGSYDEEMEIWGGENIEMSFRVWQCGGQLEIMPCSVVGHVFRSKSPHSFPKGTQVIARNQVRLAEVWMDEYKEIFYRRNTDAAKIVKQKAFGDLSKRFEIKHRLQCKNFTWYLNNIYPEVYVPDLNPVISGYIKSVGQPLCLDVGENNQGGKPLIMYTCHGLGGNQYFEYSAQHEIRHNIQKELCLHAAQGLVQLKACTYKGHKTVVTGEQIWEIQKDQLLYNPFLKMCLSANGEHPSLVSCNPSDPLQKWILSQND

SEQ ID NO: 849090 - protein, 615 aa, Homo sapiens
MAHLKRLVKLHIKRHYHKKFWKLGAVIFFFIIVLVLMQREVSVQYSKEESRMERNMKNKNKMLDLMLEAVNNIKDAMPCLQGYYTAAELKPVLDRPPQDSNAPGASGKAFKTTNLSVEEQKEKERGEAKHCFNAFASDRISLHRDLGPDTRPPECIEQKFKRCPPLPTTSVIIVFHNEAWSTLLRTVHSVLYSSPAILLKEIILVDDASVDEYLHDKLDEYVKQFSIVKIVRQRERKGLITARLLGATVATAETLTFLDAHCECFYGWLEPLLARIAENYTAVVSPDIASIDLNTFEFNKPSPYGSNHNRGNFDWSLSFGWESLPDHEKQRRKDETYPIKTPTFAGGLFSISKEYFEYIGSYDEEMEIWGGENIEMSFRVWQCGGQLEIMPCSVVGHVFRSKSPHSFPKGTQVIARNQVRLAEVWMDEYKEIFYRRNTDAAKIVKQKAFGDLSKRFEIKHRLQCKNFTWYLNNIYPEVYVPDLNPVISGYIKSVGQPLCLDVGENNQGGKPLIMYTCHGLGGNQYFEYSAQHEIRHNIQKELCLHAAQGLVQLKACTYKGHKTVVTGEQIWEIQKDQLLYNPFLKMCLSANGEHPSLVSCNPSDPLQKWILSQND

SEQ ID NO: 849091 - protein, 633 aa, Homo sapiens; identical to SEQ ID NO: 849087

SEQ ID NO: 849092 - protein, 633 aa, Homo sapiens; identical to SEQ ID NO: 849087

SEQ ID NO: 849093 - protein, 303 aa, Homo sapiens
MAHLKRLVKLHIKRHYHKKFWKLGAVIFFFIIVLVLMQREVSVQYSKEESRMERNMKNKNKMLDLMLEAVNNIKDAMPKMQIGAPVRQNIDAGERPCLQGYYTAAELKPVLDRPPQDSNAPGASGKAFKTTNLSVEEQKEKERGEAKHCFNAFASDRISLHRDLGPDTRPPECIEQKFKRCPPLPTTSVIIVFHNEAWSTLLRTVHSVLYSSPAILLKEIILVDDASVDEYLHDKLDEYVKQFSIVKIVRQRERKGLITARLLGATVATAETLTFLDAHSWDGSMVAVNLGGPNTETSTVAEA

SEQ ID NO: 849094 - protein, 104 aa, Homo sapiens
LRFNSFRRSSVWSKISVQRKPVLDRPPQDSNAPGASGKAFKTTNLSVEEQKEKERGEAKHCFNAFASDRISLHRDLGPDTRPPEYVEEYLLFILYHQALQGREG

SEQ ID NO: 849095 - protein, 633 aa, Homo sapiens; identical to SEQ ID NO: 849087

SEQ ID NO: 849096 - protein, 70 aa, Homo sapiens
RILPISASTLERNLMMYELREGFSQSSDLTKHQRIHTGEKPYECSECGKAFNRNSYLQSSPIRSTPKMDT

SEQ ID NO: 849097 - protein, 633 aa, Homo sapiens; identical to SEQ ID NO: 849087

SEQ ID NO: 849098 - protein, 192 aa, Homo sapiens
MAHLKRLVKLHIKRHYHKKFWKLGAVIFFFIIVLVLMQREVSVQYSKEESRMERNMKNKNKMLDLMLEAVNNIKDAMPKMQIGAPVRQNIDAGERPCLQGYYTAAELKPVLDRPPQDSNAPGASGKAFKTTNLSVEEQKEKERGEAKHCFNAFASDRISLHRDLGPDTRPPEYVEEYLLFILYHQALQGREG

SEQ ID NO: 849099 - protein, 469 aa, Homo sapiens
MEEKYGGDVLAGPGGGGGLGPVDVPSARTAFFMVLFQKPFSSGKTITKHQWIKIFKHAVAGCIISLLWFFGLTLCGPLRTLLLFEHSDIVVISLLSVLFTSSGGGPAKTRGAAFFIIAVICLLLFDNDDLMAKMAEHPEGHHDSALTHMLYTAIAFLGVADHKGGVLLLVLALCCKVGFHTASRKLSVDVGGAKRLQALSHLVSVLLLCPWVIVLSVTTESKVESWFSLIMPFATVIFFVMILDFYVDSICSVKMEVSKCARYGSFPIFISALLFGNFWTHPITDQLRAMNKAAHQESTEHVLSGGVVVSAIFFILSANILSSPSKRGQKGTLIGYSPEGTPLYNFMGDAFQHSSQSIPRFIKESLKQILEESDSRQIFYFLCLNLLFTFVELFYGVLTNSLGLISDGFHMLFDCSALVMGLFAALMSRWKATRIFSYGYGRIEILSGFINGLFLIVIAFLCLWSQWLD

SEQ ID NO: 849100 - protein, 510 aa, Homo sapiens
MEEKYGGDVLAGPGGGGGLGPVDVPSARLTKYIVLLCFTKFLKAVGLFESYDLLKAVHIVQFIFILKLGTAFFMVLFQKPFSSGKTITKHQWIKIFKHAVAGCIISLLWFFGLTLCGPLRTLLLFEHSDIVVISLLSVLFTSSGGGPAKTRGAAFFIIAVICLLLFDNDDLMAKMAEHPEGHHDSALTHMLYTAIAFLGVADHKGGVLLLVLALCCKVGFHTASRKLSVDVGGAKRLQALSHLVSVLLLCPWVIVLSVTTESKVESWFSLIMPFATVIFFVMILDFYVDSICSVKMEVSKCARYGSFPIFISALLFGNFWTHPITDQLRAMNKAAHQESTEHVLSGGVVVSAIFFILSANILSSPSKRGQKGTLIGYSPEGTPLYNFMGDAFQHSSQSIPRFIKESLKQILEESDSRQIFYFLCLNLLFTFVELFYGVLTNSLGLISDGFHMLFDCSALVMGLFAALMSRWKATRIFSYGYGRIEILSGFINGLFLIVIAFLCLWSQWLD

SEQ ID NO: 849101 - protein, 469 aa, Homo sapiens; identical to SEQ ID NO: 849099

SEQ ID NO: 849102 - protein, 469 aa, Homo sapiens; identical to SEQ ID NO: 849099

SEQ ID NO: 849103 - protein, 469 aa, Homo sapiens; identical to SEQ ID NO: 849099

SEQ ID NO: 849104 - protein, 469 aa, Homo sapiens; identical to SEQ ID NO: 849099

SEQ ID NO: 849105 - protein, 335 aa, Homo sapiens
MMISWLKWLNTVSFWNRSELFQVLRKTRSGGVLLLVLALCCKVGFHTASRKLSVDVGGAKRLQALSHLVSVLLLCPWVIVLSVTTESKVESWFSLIMPFATVIFFVMILDFYVDSICSVKMEVSKCARYGSFPIFISALLFGNFWTHPITDQLRAMNKAAHQESTEHVLSGGVVVSAIFFILSANILSSPSKRGQKGTLIGYSPEGTPLYNFMGDAFQHSSQSIPRFIKESLKQILEESDSRQIFYFLCLNLLFTFVELFYGVLTNSLGLISDGFHMLFDCSALVMGLFAALMSRWKATRIFSYGYGRIEILSGFINGLFLIVIAFLCLWSQWLD

SEQ ID NO: 849106 - protein, 469 aa, Homo sapiens; identical to SEQ ID NO: 849099

SEQ ID NO: 849107 - protein, 469 aa, Homo sapiens; identical to SEQ ID NO: 849099

SEQ ID NO: 849108 - protein, 137 aa, Homo sapiens
RYREAEITEGQALLKSRERDPLPRPVADFLCFSSFPRPSSLPLPPGSECPCAPRARAAARAAFPTPSPSPHSPPPPCRARRSRRRGRWRRPPAPAVPRGRSEEPERPTEASREDAAAAAEDEPAERAVPPAGRSPEG

SEQ ID NO: 849109 - protein, 1112 aa, Homo sapiens
MSLQSAQYLRQAEVLKADMTDSKLGPAEVWTSRQALQDLYQKMLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVRRDYSKGITVTKNDGKKDNNKRKTETKKCTLEKLQETGKQNVAVQVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKSIWSSSMMHPGPSALEQLLMQQKQKQQRGQGTMNPPH

SEQ ID NO: 849110 - protein, 1279 aa, Homo sapiens
RYREAEITEGQALLKSRERDPLPRPVADFLCFSSFPRPSSLPLPPGSECPCAPRARAAARAAFPTPSPSPHSPPPPCRARRSRRRGRWRRPPAPAVPRGRSEEPERPTEASREDAAAAAEDEPAERAVPPNVLNHSTFMRNWMFLQIVIVGENVSFKSQMRTENLKSEEHLKSSNIRQAEVLKADMTDSKLGPAEVWTSRQALQDLYQKMLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVRRDYSKGITVTKNDGKKDNNKRKTETKKCTLEKLQETGKQNVAVQVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKSIWSSSMMHPGPSALEQLLMQQKQKQQRGQGTMNPPH

SEQ ID NO: 849111 - protein, 1099 aa, Homo sapiens
MLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEDPKSSPLLPPDLLKSLAALEEEEELIFSNPPDLYPALLGPLASLPGRSLFKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKSIWSSSMMHPGPSALEQLLMQQKQKQQRGQGTMNPPH

SEQ ID NO: 849112 - protein, 998 aa, Homo sapiens
MLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPGHPLRAVGIRPALRVAPGQAMALPWRIPLLSSWKA

SEQ ID NO: 849113 - protein, 1049 aa, Homo sapiens
MLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKSIWSSSMMHPGPSALEQLLMQQKQKQQRGQGTMNPPH

SEQ ID NO: 849114 - protein, 1049 aa, Homo sapiens; identical to SEQ ID NO: 849113

SEQ ID NO: 849115 - protein, 1014 aa, Homo sapiens
MLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKCP

SEQ ID NO: 849116 - protein, 625 aa, Homo sapiens
MLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVRRDYSKGITVTKNDGKKDNNKRKTETKKCTLEKLQETGKQNVAVQVKSQTELRKTPVSEARKTPVTQTPTQASNSQFIPIHHPGAFPPLPSRPGKYVL

SEQ ID NO: 849117 - protein, 138 aa, Homo sapiens
RYREAEITEGQALLKSRERDPLPRPVADFLCFSSFPRPSSLPLPPGSECPCAPRARAAARAAFPTPSPSPHSPPPPCRARRSRRRGRWRRPPAPAVPRGRSEEPERPTEASREDAAAAAEDEPAERAVPPNVLNHSTL

SEQ ID NO: 849118 - protein, 169 aa, Homo sapiens
MSLQSAQYLRQAEVLKADMTDSKLGPAEVWTSRQALQDLYQKMLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIVPYNSPLL

SEQ ID NO: 849119 - protein, 1070 aa, Homo sapiens
MLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVRRDYSKGITVTKNDGKKDNNKRKTETKKCTLEKLQETGKQNVAVQVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKSIWSSSMMHPGPSALEQLLMQQKQKQQRGQGTMNPPH

SEQ ID NO: 849120 - protein, 802 aa, Homo sapiens
MSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVRRDYSKGITVTKNDGKKDNNKRKTETKKCTLEKLQETGKQNVAVQVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKSIWSSSMMHPGPSALEQLLMQQKQKQQRGQGTMNPPH

SEQ ID NO: 849121 - protein, 1049 aa, Homo sapiens; identical to SEQ ID NO: 849113

SEQ ID NO: 849122 - protein, 489 aa, Homo sapiens
CCFLKTKAVFFCFEGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKSIWSSSMMHPGPSALEQLLMQQKQKQQRGQGTMNPPH

SEQ ID NO: 849123 - protein, 1049 aa, Homo sapiens; identical to SEQ ID NO: 849113

SEQ ID NO: 849124 - protein, 1049 aa, Homo sapiens; identical to SEQ ID NO: 849113

SEQ ID NO: 849125 - protein, 138 aa, Homo sapiens; identical to SEQ ID NO: 849117

SEQ ID NO: 849126 - protein, 423 aa, Homo sapiens
TIYWQEGLLVTFDGGYLSVESSDVNWKKKKSGGMKIVCQSEVRDFSAMAFITDHVNSLIDQWFPALTATESDGTPLMEQYVPCPVCETAWAQHTDPSEKSEDVQYFDMEDCVLTAIERDFISCPRHPDLPVPLQELVPELFMTDFPARLFLENSKLEHSEDEGSVLGQGGSGTVIYRARYQGQPVAVKRFHIKKFKNFANVPADTMLRHLRATDAMKNFSEFRQEASMLHALQHPCIVALIGISIHPLCFALELAPLSSLNTVLSENARDSSFIPLGHMLTQKIAYQIASGLAYLHKKNIIFCDLKSDNILVWSLDVKEHINIKLSDYGISRQSFHEGALGVEGTPGYQAPEIRPRIVYDEKVDMFSYGMVLYELLSGQRPALGHHQLQIAKKLSKGIRPVLGQPEEVQFRRLQALMMECWDT

SEQ ID NO: 849127 - protein, 196 aa, Homo sapiens
MFCEKAMELIRELHRAPEGQLPAFNEDGLRQVLEEMKALYEQNQSDVNEAKSGGRSDLIPTIKFRHCSLLRNRRCTVAYLYDRLLRIRALRWEYGSVLPNALRFHMAAEEMEWFNNYKRSLATYMRSLGGDEGLDITQDMKPPKSLYIEVRCLKDYGEFEVDDGTSVLLKKNSQHFLPRWKCEQLIRQGVLEHILS

SEQ ID NO: 849128 - protein, 196 aa, Homo sapiens; identical to SEQ ID NO: 849127

SEQ ID NO: 849129 - protein, 196 aa, Homo sapiens; identical to SEQ ID NO: 849127

SEQ ID NO: 849130 - protein, 196 aa, Homo sapiens; identical to SEQ ID NO: 849127

SEQ ID NO: 849131 - protein, 161 aa, Homo sapiens
MKALYEQNQSDVNEAKSGGRSDLIPTIKFRHCSLLRNRRCTVAYLYDRLLRIRALRWEYGSVLPNALRFHMAAEEMEWFNNYKRSLATYMRSLGGDEGLDITQDMKPPKSLYIEVRCLKDYGEFEVDDGTSVLLKKNSQHFLPRWKCEQLIRQGVLEHILS

SEQ ID NO: 849132 - protein, 122 aa, Homo sapiens
MKALYEQNQSDVNEAKSGGRSDLIPTIKFRHCSLLRNRRCTVAYLYDRLLRIRALRWEYGSVLPNALRFHMAAEEVRCLKDYGEFEVDDGTSVLLKKNSQHFLPRWKCEQLIRQGVLEHILS

SEQ ID NO: 849133 - protein, 619 aa, Homo sapiens
SGCWGCKARAVSCWRCREEDAGARLPSSAAAAAMIPVSLVVVVVGGWTVVYLTDLVLKSSVYFKHSYEDWLENNGLSISPFHIRWQTAVFNRAFYSWGRRKARMLYQWFNFGMVFGVIAMFSSFFLLGKTLMQTLAQMMADSPSSYSSSSSSSSSSSSSSSSSSSSSSSLHNEQVLQVVVPGINLPVNQLTYFFTAVLISGVVHEIGHGIAAIREQVRFNGFGIFLFIIYPGAFVDLFTTHLQLISPVQQLRIFCADFSITQDLEIPADIVELHDINVEPLPMEDIPTESVQYEDVDGNWIYGGHNHPPLMVLQPLFTNTGYGDHDQEMLMLQTQEEVVGYCDSDNQLGNDLEDQLALPDSIEDEHFQMTLASLSASAASTSTSTQSRSKKPSKKPSGKSATSTEANPAGSSSSLGTRKWEQKQMQVKTLEGEFSVTMWSPNDNNDQGAVGEGQAENPPDYSEYLKGKKLPPGGLPGIDLSDPKQLAEFTKVKPKRSKGEPPKTVPCSYSGCEKMFRDYAAMRKHLHIHGPRVHVCAECGKAFLESSKLRRHQLVHTGEKPFQCTFEGCGKRFSLDFNLRTHLRIHTGDKPFVCPFDVCNRKFAQSTNLKTHILTHVKT

SEQ ID NO: 849134 - protein, 552 aa, Homo sapiens
SGCWGCKARAVSCWRCREEDAGARLPSSAAAAAMIPVSLVVVVVGGWTVVYLTDLVLKSSVYFKHSYEDWLENNGLSISPFHIRWQTAVFNRAFYSWGRRKARMLYQWFNFGMVFGVIAMFSSFFLLGKTLMQTLAQMMADSPSSYSSSSSSSSSSSSSSSSSSSSSSSLHNEQVLQVVVPGINLPVNQLTYFFTAVLISGVVHEIGHGIAAIREQVRFNGFGIFLFIIYPGAFVDLFTTHLQLISPVQQLRIFCAGIWHNFVLALLGILALVLLPVILLPFYYTGVGVLITEVAEDSPAIGPRGLFVGDLVTHLQDCPVTNVQDWNECLDTIAYEPQIGYCISASTLQQLSFPVRAYKRLDGSTECCNNHSLTDVCFSYRNNFNKRLHTCLPARKAVEATQVCRTNKDCKKSSSSSFCIIPSLETHTRLIKVKHPPQIDMLYVGHPLHLHYTVSITSFIPRFNFLSIDLPVVVETFVKYLISLSGALAIVNAVPCFALDGQWILNSFLDATLTSVIGDNDVKDLIGFFILLGGSVLLAANVTLGLWMVTAR

SEQ ID NO: 849135 - protein, 183 aa, Homo sapiens
DTSSRGPRCLAASLLTTQLVPHPGNCEELAKCLSTELISSLEHRGHQEGAKTMQTPVNIPVPVLRLPRGPDGFSRGFAPDGRRAPLRPEVPEIQECPIAQESLESQEQRARAALRERYLRSLLAMVGHQVSFTLHEGVRVAAHFGATDLDVANFYVSQLQTPIGVQAEALLRCSDIISYTFKP

SEQ ID NO: 849136 - protein, 131 aa, Homo sapiens
MQTPVNIPVPVLRLPRGPDGFSRGFAPDGRRAPLRPEVPEIQECPIAQESLESQEQRARAALRERYLRSLLAMVGHQVSFTLHEGVRVAAHFGATDLDVANFYVSQLQTPIGVQAEALLRCSDIISYTFKP

SEQ ID NO: 849137 - protein, 131 aa, Homo sapiens; identical to SEQ ID NO: 849136

SEQ ID NO: 849138 - protein, 1046 aa, Homo sapiens
MQRGSRTVEEGARDAEPTRACRGKWRRSRRADAPRVGEGTEVRSPSYPARDIELRWASLRWESRSEFFQARPGCSGKGPAPVPRSLSGLAPGNPAQGDGRGLTCSHRRLRPPSHGLPEARPADENAAAAMAADVVGDVYVLVEHPFEYTGKDGRRVAIRPNERYRLLRRSTEHWWHVRREPGGRPFYLPAQYVRELPALGNPAAAAPPGPHPSPAAPEPLAYDYRFVSAAATAGPDGAPEESGGRASSLCGPAQRGAATQRSSLAPGLPACLYLRPAAPVRPAQSLNDLACAAVSPPAGLLGSSGSFKACSVAGSWVCPRPLARSDSENVYEVIQDLHVPPREESAEQVDDPPEPVYANIERQPRATSPGAAAAPLPSPVWETHTDAGTGRPYYYNPDTGVTTWESPFEAAEGAASPATSPASVDSHVSLETEWGQYWDEESRRVFFYNPLTGETAWEDEAENEPEEELEMQPGLSPGSPGDPRVRGRARVGGSPLSASDPASCSQRPRDTRPPTPETDYPESLTSYPEEDYSPVGSFGEPGPTSPLTTPPGWSCHVSQDKQMLYTNHFTQEQWVRLEDPHGKPYFYNPEDSSVRWELPQVPVPAPRSIHKSSQDGDTPAQASPPEEKVPAELDEVGSWEEVSPATAAVRTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQSRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 849139 - protein, 961 aa, Homo sapiens
MQRGSRTVEEGARDAEPTRACRGKWRRSRRADAPRVGEGTEVRSPSYPARDIELRWASLRWESRSEFFQARPGCSGKGPAPVPRSLSGLAPGNPAQGDGRGLTCSHRRLRPPSHGLPEARPADENAAAAMAADVVGDVYVLVEHPFEYTGKDGRRVAIRPNERYRLLRRSTEHWWHVRREPGGRPFYLPAQYVRELPALGNPAAAAPPGPHPSPAAPEPLAYDYRFVSAAATAGPDGAPEESGGRASSLCGPAQRGAATQRSSLAPGLPACLYLRPAAPVRPAQSLNDLACAAVSPPAGLLGSSGSFKACSVAGSWVCPRPLARSDSENVYEVIQDLHVPPREESAEQVDDPPEPVYANIERQPRATSPGAAAAPLPSPVWETHTDAGTGRPYYYNPDTGVTTWESPFEAAEGAASPATSPASVDSHVSLETEWGQYWDEESRRVFFYNPLTGETAWEDEAENEPEEELEMQPGLSPGSPGDPRPPTPETDYPESLTSYPEEDYSPVGSFVGEAGGPPGKPYFYNPEDSSVRWELPQVPVPAPRSIHKSSQDGDTPAQASPPEEKTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQSRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 849140 - protein, 715 aa, Homo sapiens
GPGCTGRKVYDAAREPHSRGGSAGRRAHARLPGQVEAKPASGRPEVDDPPEPVYANIERQPRATSPGAAAAPLPSPVWETHTDAGTGRPYYYNPDTGVTTWESPFEAAEGAASPATSPASVDSHVSLETEWGQYWDEESRRVFFYNPLTGETAWEDEAENEPEEELEMQPGLSPGSPGDPRPPTPETDYPESLTSYPEEDYSPVGSFGEPGPTSPLTTPPGWSCHVSQDKQMLYTNHFTQEQWVRLEDPHGKPYFYNPEDSSVRWELPQVPVPAPRSIHKSSQDGDTPAQASPPEEKVPAELDEVGSWEEVSPATAAVRTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQSRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 849141 - protein, 715 aa, Homo sapiens
DWKEPGALIPSPPLGTEVDDPPEPVYANIERQPRATSPGAAAAPLPSPVWETHTDAGTGRPYYYNPDTGVTTWESPFEAAEGAASPATSPASVDSHVSLETEWGQYWDEESRRVFFYNPLTGETAWEDEAENEPEEELEMQPGLSPGSPGDPRVRGRARVGGSPLSASDPASCSQRPRDTRPPTPETDYPESLTSYPEEDYSPVGSFGEPGPTSPLTTPPGWSCHVSQDKQMLYTNHFTQEQWVRLEDPHGKPYFYNPEDSSVRWELPQVPVPAPRSIHKSSQDGDTPAQASPPEEKVPAELDEVGSWEEVSPATAAVRTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQSRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 849142 - protein, 1113 aa, Homo sapiens
MQRGSRTVEEGARDAEPTRACRGKWRRSRRADAPRVGEGTEVRSPSYPARDIELRWASLRWESRSEFFQARPGCSGKGPAPVPRSLSGLAPGNPAQGDGRGLTCSHRRLRPPSHGLPEARPADENAAAAMAADVVGDVYVLVEHPFEYTGKDGRRVAIRPNERYRLLRRSTEHWWHVRREPGGRPFYLPAQYVRELPALGNPAAAAPPGPHPSPAAPEPLAYDYRFVSAAATAGPDGAPEESGGRASSLCGPAQRGAATQRSSLAPGLPACLYLRPAAPVRPAQSLNDLACAAVSPPAGLLGSSGSFKACSVAGSWVCPRPLARSDSENVYEVIQDLHVPPREESAEQVDDPPEPVYANIERQPRATSPGAAAAPLPSPVWETHTDAGTGRPYYYNPDTGVTTWESPFEAAEGAASPATSPASVDSHVSLETEWGQYWDEESRRVFFYNPLTGETAWEDEAENEPEEELEMQPGLSPGSPGDPRVRGRARVGGSPLSASDPASCSQRPRDTRPPTPETDYPESLTSYPEEDYSPVGSFGEPGPTSPLTTPPGWSCHVSQDKQMLYTNHFTQEQWVRLEDPHGKPYFYNPEDSSVRWELPQVPVPAPRSIHKSSQDGDTPAQASPPEEKVPAELDEVGSWEEVSPATAAVRTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQSRPTLQSLREKGYIKDQVFGCALAALCERERSRVPRFVQQCIRAVEARGTCAAGVRAAGIGVPAGLLPGPQLETPGWTQGPGGKYGRPRVGVIAGTRSPTLSPSLNPGSAPPSGPGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 849143 - protein, 1046 aa, Homo sapiens; identical to SEQ ID NO: 849138

SEQ ID NO: 849144 - protein, 154 aa, Homo sapiens
RGTDFPSVLLPSSATDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 849145 - protein, 1046 aa, Homo sapiens; identical to SEQ ID NO: 849138

SEQ ID NO: 849146 - protein, 499 aa, Homo sapiens
MQRGSRTVEEGARDAEPTRACRGKWRRSRRADAPRVGEGTEVRSPSYPARDIELRWASLRWESRSEFFQARPGCSGKGPAPVPRSLSGLAPGNPAQGDGRGLTCSHRRLRPPSHGLPEARPADENAAAAMAADVVGDVYVLVEHPFEYTGKDGRRVAIRPNERYRLLRRSTEHWWHVRREPGGRPFYLPAQYVRELPALGNPAAAAPPGPHPSPAAPEPLAYDYRFVSAAATAGPDGAPEESGGRASSLCGPAQRGAATQRSSLAPGLPACLYLRPAAPVRPAQSLNDLACAAVSPPAGLLGSSGSFKACSVAGSWVCPRPLARSDSENVYEVIQDLHVPPREESAEQVDDPPEPVYANIERQPRATSPGAAAAPLPSPVWETHTDAGTGRPYYYNPDTGVTTWESPFEAAEGAASPATSPASVDSHVSLETEWGQYWDEESRRVFFYNPLTGETAWEDEAENEPEEELEMQPGLSPGSPGDPRVRGRARVGGSTSERL

SEQ ID NO: 849147 - protein, 917 aa, Homo sapiens
MAADVVGDVYVLVEHPFEYTGKDGRRVAIRPNERYRLLRRSTEHWWHVRREPGGRPFYLPAQYVRELPALGNPAAAAPPGPHPSPAAPEPLAYDYRFVSAAATAGPDGAPEESGGRASSLCGPAQRGAATQRSSLAPGLPACLYLRPAAPVRPAQSLNDLACAAVSPPAGLLGSSGSFKACSVAGSWVCPRPLARSDSENVYEVIQDLHVPPREESAEQVDDPPEPVYANIERQPRATSPGAAAAPLPSPVWETHTDAGTGRPYYYNPDTGVTTWESPFEAAEGAASPATSPASVDSHVSLETEWGQYWDEESRRVFFYNPLTGETAWEDEAENEPEEELEMQPGLSPGSPGDPRVRGRARVGGSPLSASDPASCSQRPRDTRPPTPETDYPESLTSYPEEDYSPVGSFGEPGPTSPLTTPPGWSCHVSQDKQMLYTNHFTQEQWVRLEDPHGKPYFYNPEDSSVRWELPQVPVPAPRSIHKSSQDGDTPAQASPPEEKVPAELDEVGSWEEVSPATAAVRTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQSRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 849148 - protein, 721 aa, Homo sapiens
FPVALCQHWGSAPGLYPQNLPRALSRQFRGARMVDIIAKVTRRQSRALPAQVDDPPEPVYANIERQPRATSPGAAAAPLPSPVWETHTDAGTGRPYYYNPDTGVTTWESPFEAAEGAASPATSPASVDSHVSLETEWGQYWDEESRRVFFYNPLTGETAWEDEAENEPEEELEMQPGLSPGSPGDPRPPTPETDYPESLTSYPEEDYSPVGSFGEPGPTSPLTTPPGWSCHVSQDKQMLYTNHFTQEQWVRLEDPHGKPYFYNPEDSSVRWELPQVPVPAPRSIHKSSQDGDTPAQASPPEEKVPAELDEVGSWEEVSPATAAVRTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQSRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 849149 - protein, 503 aa, Homo sapiens
TIPLPTVGEAGGPPREAILLQSRGLLCSMGAAPGNNLGKGGVGERGRDHIRLCLSPQVPVPAPRSIHKSSQDGDTPAQASPPEEKVPAELDEVGSWEEVSPATAAVRTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQSRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 849150 - protein, 1046 aa, Homo sapiens; identical to SEQ ID NO: 849138

SEQ ID NO: 849151 - protein, 1030 aa, Homo sapiens
MQRGSRTVEEGARDAEPTRACRGKWRRSRRADAPRVGEGTEVRSPSYPARDIELRWASLRWESRSEFFQARPGCSGKGPAPVPRSLSGLAPGNPAQGDGRGLTCSHRRLRPPSHGLPEARPADENAAAAMAADVVGDVYVLVEHPFEYTGKDGRRVAIRPNERYRLLRRSTEHWWHVRREPGGRPFYLPAQYVRELPALGNPAAAAPPGPHPSPAAPEPLAYDYRFVSAAATAGPDGAPEESGGRASSLCGPAQRGAATQRSSLAPGLPACLYLRPAAPVRPAQSLNDLACAAVSPPAGLLGSSGSFKACSVAGSWVCPRPLARSDSENVYEVIQDLHVPPREESAEQVDDPPEPVYANIERQPRATSPGAAAAPLPSPVWETHTDAGTGRPYYYNPDTGVTTWESPFEAAEGAASPATSPASVDSHVSLETEWGQYWDEESRRVFFYNPLTGETAWEDEAENEPEEELEMQPGLSPGSPGDPRVRGRARVGGSPLSASDPASCSQRPRDTRPPTPETDYPESLTSYPEEDYSPVGSFGEPGPTSPLTTPPGWSCHVSQDKQMLYTNHFTQEQWVRLEDPHGKPYFYNPEDSSVRWELPQVPVPAPRSIHKSSQDGDTPAQASPPEEKVPAELDEVGSWEEVSPATAAVRTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQSRPTLQSLREKGYIKDQVFGCALAALCERERSRVPRFVQQCIRAVEARGTCAAGVRAAGIGVPAGLLPGPQLETPGWTQGPGGKYGRPRVGVIAGTRSPTLSPSLNPGSAPPSGPGLDIDGLYRISGNLATIQKLRYKVDHDERLDLDDGRWEDVHVITGALKLFFRELPEPLFPFSHFRQFIAAISEHLGQVGRMG

SEQ ID NO: 849152 - protein, 1030 aa, Homo sapiens; identical to SEQ ID NO: 849151

SEQ ID NO: 849153 - protein, 1046 aa, Homo sapiens; identical to SEQ ID NO: 849138

SEQ ID NO: 849154 - protein, 854 aa, Homo sapiens
MEMPLPPDDQELRNVIDKLAQFVARNGPEFEKMTMEKQKDNPKFSFLFGGEFYSYYKCKLALEQQQLICKQQTPELEPAATMPPLPQPPLAPAAPIPPAQGAPSMDELIQQSQWNLQQQEQHLLALRQEQVTAAVAHAVEQQMQKLLEETQLDMNEFDNLLQPIIDTCTKDAISAGKNWMFSNAKSPPHCELMAGHLRNRITADGAHFELRLHLIYLINDVLHHCQRKQARELLAALQKVVVPIYCTSFLAVEEDKQQKIARLLQLWEKNGYFDDSIIQQLQSPALGLGQYQATLINEYSSVVQPVQLAFQQQIQTLKTQHEEFVTSLAQQQQQQQQQQQQLQMPQMEAEVKATPPPPAPPPAPAPAPAIPPTTQPDDSKPPIQMPGSSEYEAPGGVQDPAAAGPRGPGPHDQIPPNKPPWFDQPHPVAPWGQQQPPEQPPYPHHQGGPPHCPPWNNSHEGMWGEQRGDPGWNGQRDAPWNNQPDAAWNSQFEGPWNSQHEQPPWGGGQREPPFRMQRPPHFRGPFPPHQQHPQFNQPPHPHNFNRFPPRFMQDDFPPRHPFERPPYPHRFDYPQGDFPAEMGPPHHHPGHRMPHPGINEHPPWAGPQHPDFGPPPHGFNGQPPHMRRQGPPHINHDDPSLVPNVPYFDLPAGLMAPLVKLEDHEYKPLDPKDIRLPPPMPPSERLLAAVEAFYSPPSHDRPRNSEGWEQNGLYEFFRAKMRARRRKGQEKRNSGPSRSRSRSKSRGRSSSRSNSRSSKSSGSYSRSRSRSCSRSYSRSRSRSRSRSRSSRSRSRSQSRSRSKSYSPGRRRRSRSRSPTPPSGISGTSIKAWAWLWMTPMRTTAGTRATPSSPA

SEQ ID NO: 849155 - protein, 916 aa, Homo sapiens
MEMPLPPDDQELRNVIDKLAQFVARNGPEFEKMTMEKQKDNPKFSFLFGGEFYSYYKCKLALEQQQLICKQQTPELEPAATMPPLPQPPLAPAAPIPPAQGAPSMDELIQQSQWNLQQQEQHLLALRQEQVTAAVAHAVEQQMQKLLEETQLDMNEFDNLLQPIIDTCTKDAISAGKNWMFSNAKSPPHCELMAGHLRNRITADGAHFELRLHLIYLINDVLHHCQRKQARELLAALQKVVVPIYCTSFLAVEEDKQQKIARLLQLWEKNGYFDDSIIQQLQSPALGLGQYQATLINEYSSVVQPVQLAFQQQIQTLKTQHEEFVTSLAQQQQQQQQQQQQLQMPQMEAEVKATPPPPAPPPAPAPAPAIPPTTQPDDSKPPIQMPGSSEYEAPGGVQDPAAAGPRGPGPHDQIPPNKPPWFDQPHPVAPWGQQQPPEQPPYPHHQGGPPHCPPWNNSHEGMWGEQRGDPGWNGQRDAPWNNQPDAAWNSQFEGPWNSQHEQPPWGGGQREPPFRMQRPPHFRGPFPPHQQHPQFNQPPHPHNFNRFPPRFMQDDFPPRHPFERPPYPHRFDYPQGDFPAEMGPPHHHPGHRMPHPGINEHPPWAGPQHPDFGPPPHGFNGQPPHMRRQGPPHINHDDPSLVPNVPYFDLPAGLMAPLVKLEDHEYKPLDPKDIRLPPPMPPSERLLAAVEAFYSPPSHDRPRNSEGWEQNGLYEFFRAKMRARRRKGQEKRNSGPSRSRSRSKSRGRSSSRSNSRSSKSSGSYSRSRSRSCSRSYSRSRSRSRSRSRSSRSRSRSQSRSRSKSYSPGRRRRSRSRSPTPPSSAGLGSNSAPPIPDSRLGEENKGHQMLVKMGWSGSGGLGAKEQGIQDPIKGGDVRDKWDQYKGVGVALDDPYENYRRNKSYSFIARMKARDECK

SEQ ID NO: 849156 - protein, 927 aa, Homo sapiens
MEMPLPPDDQELRNVIDKLAQFVARNGPEFEKMTMEKQKDNPKFSFLFGGEFYSYYKCKLALEQQQLICKQQTPELEPAATMPPLPQPPLAPAAPIPPAQGAPSMDELIQQSQWNLQQQEQHLLALRQEQVTAAVAHAVEQQMQKLLEETQLDMNEFDNLLQPIIDTCTKDAISAGKNWMFSNAKSPPHCELMAGHLRNRITADGAHFELRLHLIYLINDVLHHWALTRGKSLPHSQRKQARELLAALQKVVVPIYCTSFLAVEEDKQQKIARLLQLWEKNGYFDDSIIQQLQSPALGLGQYQATLINEYSSVVQPVQLAFQQQIQTLKTQHEEFVTSLAQQQQQQQQQQQQLQMPQMEAEVKATPPPPAPPPAPAPAPAIPPTTQPDDSKPPIQMPGSSEYEAPGGVQDPAAAGPRGPGPHDQIPPNKPPWFDQPHPVAPWGQQQPPEQPPYPHHQGGPPHCPPWNNSHEGMWGEQRGDPGWNGQRDAPWNNQPDAAWNSQFEGPWNSQHEQPPWGGGQREPPFRMQRPPHFRGPFPPHQQHPQFNQPPHPHNFNRFPPRFMQDDFPPRHPFERPPYPHRFDYPQGDFPAEMGPPHHHPGHRMPHPGINEHPPWAGPQHPDFGPPPHGFNGQPPHMRRQGPPHINHDDPSLVPNVPYFDLPAGLMAPLVKLEDHEYKPLDPKDIRLPPPMPPSERLLAAVEAFYSPPSHDRPRNSEGWEQNGLYEFFRAKMRARRRKGQEKRNSGPSRSRSRSKSRGRSSSRSNSRSSKSSGSYSRSRSRSCSRSYSRSRSRSRSRSRSSRSRSRSQSRSRSKSYSPGRRRRSRSRSPTPPSSAGLGSNSAPPIPDSRLGEENKGHQMLVKMGWSGSGGLGAKEQGIQDPIKGGDVRDKWDQYKGVGVALDDPYENYRRNKSYSFIARMKARDECK

SEQ ID NO: 849157 - protein, 941 aa, Homo sapiens
MEMPLPPDDQELRNVIDKLAQFVARNGPEFEKMTMEKQKDNPKFSFLFGGEFYSYYKCKLALEQQQLICKQQTPELEPAATMPPLPQPPLAPAAPIPPAQGAPSMDELIQQSQWNLQQQEQHLLALRQEQVTAAVAHAVEQQMQKLLEETQLDMNEFDNLLQPIIDTCTKDAISAGKNWMFSNAKSPPHCELMAGHLRNRITADGAHFELRLHLIYLINDVLHHCQRKQARELLAALQKVVVPIYCTSFLAVEEDKQQKIARLLQLWEKNGYFDDSIIQQLQSPALGLGQYQATLINEYSSVVQPVQLAFQQQIQTLKTQHEEFVTSLAQQQQQQQQQQQQLQMPQMEAEVKATPPPPAPPPAPAPAPAIPPTTQPDDSKPPIQMPGSSEYEAPGGVQDPAAAGPRGPGPHDQIPPNKPPWFDQPHPVAPWGQQQPPEQPPYPHHQGGPPHCPPWNNSHEGMWGEQRGDPGWNGQRDAPWNNQPDAAWNSQFEGPWNSQHEQPPWGGGQREPPFRMQRPPHFRGPFPPHQQHPQFNQPPHPHNFNRFPPRFMQDDFPPRHPFERPPYPHRFDYPQGDFPAEMGPPHHHPGHRMPHPGINEHPPWAGPQHPDFGPPPHGFNGQPPHMRRQGPPHINHDDPSLVPNVPYFDLPAGLMAPLVKLEDHEYKPLDPKDIRLPPPMPPSERLLAAVEAFYSPPSHDRPRNSEGWEQNGLYEFFRAKMRARRRKGQEKRNSGPSRSRSRSKSRGRSSSRSNSRSSKSSGSYSRSRSRSCSRSYSRSRSRSRSRSRSSRSRSRSQSRSRSKSYSPGRRRRSRSRSPTPPSSAGLGSNSAPPIPDSRLGEENKGHQMLVKMGWSGSGGLGAKEQGIQDPIKGGDVRDKWDQYKGVGVALDDPYENYRRNKSYSSSPHPPALTWLPLGCVGTKPKPSAMTARGLKNRNTKL

SEQ ID NO: 849158 - protein, 774 aa, Homo sapiens
MQKLLEETQLDMNEFDNLLQPIIDTCTKDAISAGKNWMFSNAKSPPHCELMAGHLRNRITADGAHFELRLHLIYLINDVLHHCQRKQARELLAALQKVVVPIYCTSFLAVEEDKQQKIARLLQLWEKNGYFDDSIIQQLQSPALGLGQYQATLINEYSSVVQPVQLAFQQQIQTLKTQHEEFVTSLAQQQQQQQQQQQQLQMPQMEAEVKATPPPPAPPPAPAPAPAIPPTTQPDDSKPPIQMPGSSEYEAPGGVQDPAAAGPRGPGPHDQIPPNKPPWFDQPHPVAPWGQQQPPEQPPYPHHQGGPPHCPPWNNSHEGMWGEQRGDPGWNGQRDAPWNNQPDAAWNSQFEGPWNSQHEQPPWGGGQREPPFRMQRPPHFRGPFPPHQQHPQFNQPPHPHNFNRFPPRFMQDDFPPRHPFERPPYPHRFDYPQGDFPAEMGPPHHHPGHRMPHPGINEHPPWAGPQHPDFGPPPHGFNGQPPHMRRQGPPHINHDDPSLVPNVPYFDLPAGLMAPLVKLEDHEYKPLDPKDIRLPPPMPPSERLLAAVEAFYSPPSHDRPRNSEGWEQNGLYEFFRAKMRARRRKGQEKRNSGPSRSRSRSKSRGRSSSRSNSRSSKSSGSYSRSRSRSCSRSYSRSRSRSRSRSRSSRSRSRSQSRSRSKSYSPGRRRRSRSRSPTPPSSAGLGSNSAPPIPDSRLGEENKGHQMLVKMGWSGSGGLGAKEQGIQDPIKGGDVRDKWDQYKGVGVALDDPYENYRRNKSYSFIARMKARDECK

SEQ ID NO: 849159 - protein, 132 aa, Homo sapiens
LVTVSMHASCGCEVLITVIPINVSDYFLKRITCLDFSSSAGLGSNSAPPIPDSRLGEENKGHQMLVKMGWSGSGGLGAKEQGIQDPIKGGDVRDKWDQYKGVGVALDDPYENYRRNKSYSFIARMKARDECK

SEQ ID NO: 849160 - protein, 616 aa, Homo sapiens
MEMPLPPDDQELRNVIDKLAQFVARNGPEFEKMTMEKQKDNPKFSFLFGGEFYSYYKCKLALEQQQLICKQQTPELEPAATMPPLPQPPLAPAAPIPPAQGAPSMDELIQQSQWNLQQQEQHLLALRQEQVTAAVAHAVEQQMQKLLEETQLDMNEFDNLLQPIIDTCTKDAISAGKNWMFSNAKSPPHCELMAGHLRNRITADGAHFELRLHLIYLINDVLHHCQRKQARELLAALQKVVVPIYCTSFLAVEEDKQQKIARLLQLWEKNGYFDDSIIQQLQSPALGLGQYQATLINEYSSVVQPVQLAFQQQIQTLKTQHEEFVTSLAQQQQQQQQQQQQLQMPQMEAEVKATPPPPAPPPAPAPAPAIPPTTQPDDSKPPIQMPGSSEYEAPGGVQDPAAAGPRGPGPHDQIPPNKPPWFDQPHPVAPWGQQQPPEQPPYPHHQGGPPHCPPWNNSHEGMWGEQRGDPGWNGQRDAPWNNQPDAAWNSQFEGPWNSQHEQPPWGGGQREPPFRMQRPPHFRGPFPPHQQHPQFNQPPHPHNFNRFPPRFMQDDFPPRHPFERPPYPHRFDYPQGDFPAGECTGAWVGPGGGIHGSPAEQAGGAACGPAMLLSAQ

SEQ ID NO: 849161 - protein, 260 aa, Homo sapiens
DQRHQTKHTNNNTHNTQTSLGAPVRHEGEQTARLFFRAKMRARRRKGQEKRNSGPSRSRSRSKSRGRSSSRSNSRSSKSSGSYSRSRSRSCSRSYSRSRSRSRSRSRSSRSRSRSQSRSRSKSYSPGRRRRSRSRSPTPPSSAGLGSNSAPPIPDSRLGEENKGHQMLVKMGWSGSGGLGAKEQGIQDPIKGGDVRDKWDQYKGVGVALDDPYENYRRNKSYSSSPHPPALTWLPLGCVGTKPKPSAMTARGLKNRNTKL

SEQ ID NO: 849162 - protein, 588 aa, Homo sapiens
MEMPLPPDDQELRNVIDKLAQFVARNGPEFEKMTMEKQKDNPKFSFLFGGEFYSYYKCKLALEQQQLICKQQTPELEPAATMPPLPQPPLAPAAPIPPAQGAPSMDELIQQSQWNLQQQEQHLLALRQEQVTAAVAHAVEQQMQKLLEETQLDMNEFDNLLQPIIDTCTKDAISAGKNWMFSNAKSPPHCELMAGHLRNRITADGAHFELRLHLIYLINDVLHHCQRKQARELLAALQKVVVPIYCTSFLAVEEDKQQKIARLLQLWEKNGYFDDSIIQQLQSPALGLGQYQATLINEYSSVVQPVQLAFQQQIQTLKTQHEEFVTSLAQQQQQQQQQQQQLQMPQMEAEVKATPPPPAPPPAPAPAPAIPPTTQPDDSKPPIQMPGSSEYEAPGGVQDPAAAGPRGPGPHDQIPPNKPPWFDQPHPVAPWGQQQPPEQPPYPHHQGGPPHCPPWNNSHEGMWGEQRGDPGWNGQRDAPWNNQPDAAWNSQFEGPWNSQHEQPPPPIPPAQGAPTMDELIQQSQLNLQQQEQHLLALRQEQVTAAVAHAVEQQQKLLEETQLDMNEFDNLLQPIIDTCTKDAISAGKN

SEQ ID NO: 849163 - protein, 916 aa, Homo sapiens; identical to SEQ ID NO: 849155

SEQ ID NO: 849164 - protein, 916 aa, Homo sapiens; identical to SEQ ID NO: 849155

SEQ ID NO: 849165 - protein, 916 aa, Homo sapiens; identical to SEQ ID NO: 849155

SEQ ID NO: 849166 - protein, 455 aa, Homo sapiens
MWGEQRGDPGWNGQRDAPWNNQPDAAWNSQFEGPWNSQHEQPPWGGGQREPPFRMQRPPHFRGPFPPHQQHPQFNQPPHPHNFNRFPPRFMQDDFPPRHPFERPPYPHRFDYPQGDFPAEMGPPHHHPGHRMPHPGINEHPPWAGPQHPDFGPPPHGFNGQPPHMRRQGPPHINHDDPSLVPNVPYFDLPAGLMAPLVKLEDHEYKPLDPKDIRLPPPMPPSERLLAAVEAFYSPPSHDRPRNSEGWEQNGLYEFFRAKMRARRRKGQEKRNSGPSRSRSRSKSRGRSSSRSNSRSSKSSGSYSRSRSRSCSRSYSRSRSRSRSRSRSSRSRSRSQSRSRSKSYSPGRRRRSRSRSPTPPSSAGLGSNSAPPIPDSRLGEENKGHQMLVKMGWSGSGGLGAKEQGIQDPIKGGDVRDKWDQYKGVGVALDDPYENYRRNKSYSFIARMKARDECK

SEQ ID NO: 849167 - protein, 681 aa, Homo sapiens
MEMPLPPDDQELRNVIDKLAQFVARNGPEFEKMTMEKQKDNPKFSFLFGGEFYSYYKCKLALEQQQLICKQQTPELEPAATMPPLPQPPLAPAAPIPPAQGAPSMDELIQQSQWNLQQQEQHLLALRQEQVTAAVAHAVEQQMQKLLEETQLDMNEFDNLLQPIIDTCTKDAISAGKNWMFSNAKSPPHCELMAGHLRNRITADGAHFELRLHLIYLINDVLHHCQRKQARELLAALQKVVVPIYCTSFLAVEEDKQQKIARLLQLWEKNGYFDDSIIQQLQSPALGLGQYQATLINEYSSVVQPVQLAFQQQIQTLKTQHEEFVTSLAQQQQQQQQQQQQLQMPQMEAEVKATPPPPAPPPAPAPAPAIPPTTQPDDSKPPIQMPGSSEYEAPGGVQDPAAAGPRGPGPHDQIPPNKPPWFDQPHPVAPWGQQQPPEQPPYPHHQGGPPHCPPWNNSHEGMWGEQRGDPGWNGQRDAPWNNQPDAAWNSQFEGPWNSQHEQPPWGGGQREPPFRMQRPPHFRGPFPPHQQHPQFNQPPHPHNFNRFPPRFMQDDFPPRHPFERPPYPHRFDYPQGDFPAEMGPPHHHPGHRMPHPGINEHPPWAGPQHPDFGPPPHGFNGQPPHMRRQGPPHINHDDPSLVPNVPYFDLPAGLMAPLVKVMPHSGLQAEHAYHTGPRFSL

SEQ ID NO: 849168 - protein, 353 aa, Homo sapiens
MEMPLPPDDQELRNVIDKLAQFVARNGPEFEKMTMEKQKDNPKFSFLFGGEFYSYYKCKLALEQQQLICKQQTPELEPAATMPPLPQPPLAPAAPIPPAQGAPSMDELIQQSQWNLQQQEQHLLALRQEQVTAAVAHAVEQQMQKLLEETQLDMNEFDNLLQPIIDTCTKDAISAGKNWMFSNAKSPPHCELMAGHLRNRITADGAHFELRLHLIYLINDVLHHCQRKQARELLAALQKVVVPIYCTSFLAVEEDKQQKIARLLQLWEKNGYFDDSIIQQLQIPSRAWSPTPASAFHSIISFHTPEGRGGQEGSCSCQKLVGDRWESATPGVHGQPGAIPFICTETFLKNSFQ

SEQ ID NO: 849169 - protein, 111 aa, Homo sapiens
MAGKQAVSASGKWLDGIRKWYYNAAGFNKLGLMRDDTIYEDEDVKEAIRRLPENLYNDRMFRIKRALDLNLKHQILPKEQWTKYEEENFYLEPYLKEVIRERKEREEWAKK

SEQ ID NO: 849170 - protein, 96 aa, Homo sapiens
SFSSLLVLFFFFLPSLLMRDDTIYEDEDVKEAIRRLPENLYNDRMFRIKRALDLNLKHQILPKEQWTKYEEENFYLEPYLKEVIRERKEREEWAKK

SEQ ID NO: 849171 - protein, 111 aa, Homo sapiens; identical to SEQ ID NO: 849169

SEQ ID NO: 849172 - protein, 111 aa, Homo sapiens; identical to SEQ ID NO: 849169

SEQ ID NO: 849173 - protein, 112 aa, Homo sapiens
FALEYPHVDTSGKWLDGIRKWYYNAAGFNKLGLMRDDTIYEDEDVKEAIRRLPENLYNDRMFRIKRALDLNLKHQILPKEQWTKYEEENFYLEPYLKEVIRERKEREEWAKK

SEQ ID NO: 849174 - protein, 111 aa, Homo sapiens; identical to SEQ ID NO: 849169

SEQ ID NO: 849175 - protein, 137 aa, Homo sapiens
RLIDVIIDHTRLVLLAGNAAAHKSHQGTRMFMNIVSGKWLDGIRKWYYNAAGFNKLGLMRDDTIYEDEDVKEAIRRLPENLYNDRMFRIKRALDLNLKHQILPKEQWTKYEEENFYLEPYLKEVIRERKEREEWAKK

SEQ ID NO: 849176 - protein, 111 aa, Homo sapiens; identical to SEQ ID NO: 849169

SEQ ID NO: 849177 - protein, 112 aa, Homo sapiens
EPRGGENSQRGERGWKAYRKWYYNAAGFNKLGLMRDDTIYEDEDVKEAIRRLPENLYNDRMFRIKRALDLNLKHQILPKEQWTKYEEENFYLEPYLKEVIRERKEREEWAKK

SEQ ID NO: 849178 - protein, 161 aa, Homo sapiens
MAGKQAVSASGKWLDGIRKWYYNAAGFNKLGLMRDDTIYEDEDVKEAIRRLPENLYNDRMFRIKRALDLNLKHQILPKEQWTKYEEVFAVPALHSASYLDEKISPLSVPPDPKKSFCEANSHPLNCIETRQRPVDIHFFFFPKRLPPHNLSKQLITPSPQI

SEQ ID NO: 849179 - protein, 105 aa, Homo sapiens
MAGKQAVSASGKWLDGIRKWYYNAAGFNKLGLMRDDTIYEDEDVKEAIRRLPENLYNDRMFRIKRALDLNLKHQILPKEQWTKYEEENFYLEPYLKEVIRERQLL

SEQ ID NO: 849180 - protein, 105 aa, Homo sapiens; identical to SEQ ID NO: 849179

SEQ ID NO: 849181 - protein, 141 aa, Homo sapiens
MAGKQAVSASGKWLDGIRKWYYNAAGFNKLGLMRDDTIYEDEDVKEAIRRLPENLYNDRMFRIKRALDLNLKHQILPKEQWTKYEEVFAVPALHSASYLDEKISPLSVPPDPKKSFCEANSHPLNCIETRQRRKISTLNRI

SEQ ID NO: 849182 - protein, 141 aa, Homo sapiens; identical to SEQ ID NO: 849181

SEQ ID NO: 849183 - protein, 123 aa, Homo sapiens
GRLLLLNSRPRRLAGKQAVSASGKWLDGIRKWYYNAAGFNKLGLMRDDTIYEDEDVKEAIRRLPENLYNDRMFRIKRALDLNLKHQILPKEQWTKYEEENFYLEPYLKEVIRERKEREEWAKK

SEQ ID NO: 849184 - protein, 111 aa, Homo sapiens; identical to SEQ ID NO: 849169

SEQ ID NO: 849185 - protein, 123 aa, Homo sapiens; identical to SEQ ID NO: 849183

SEQ ID NO: 849186 - protein, 104 aa, Homo sapiens
LTRVPLIWWYRKWYYNAAGFNKLGLMRDDTIYEDEDVKEAIRRLPENLYNDRMFRIKRALDLNLKHQILPKEQWTKYEEENFYLEPYLKEVIRERKEREEWAKK

SEQ ID NO: 849187 - protein, 111 aa, Homo sapiens; identical to SEQ ID NO: 849169

SEQ ID NO: 849188 - protein, 111 aa, Homo sapiens; identical to SEQ ID NO: 849169

SEQ ID NO: 849189 - protein, 111 aa, Homo sapiens; identical to SEQ ID NO: 849169

SEQ ID NO: 849190 - protein, 129 aa, Homo sapiens
MRDDTIYEDEDVKEAIRRLPENLYNDRMFRIKRALDLNLKHQILPKEQWTKYEEVFAVPALHSASYLDEKISPLSVPPDPKKSFCEANSHPLNCIETRQRPVDIHFFFFPKRLPPHNLSKQLITPSPQI

SEQ ID NO: 849191 - protein, 108 aa, Homo sapiens
MAGKQAVSASGKWLDGIRKWYYNAAGFNKLGLMRDDTIYEDEDVKEAIRRLPENLYNDRMFRIKRALDLNLKHQILPKEQWTKYEEKKTTLSLTCEMILLKLLSKSLI

SEQ ID NO: 849192 - protein, 141 aa, Homo sapiens; identical to SEQ ID NO: 849181

SEQ ID NO: 849193 - protein, 167 aa, Homo sapiens
SDTPYSETPACHSLSLAACLHFGPFLSDDRKYGFVSHSQQRNSRLWEACWDPLMRAGTMAIKNLCEGVRRAGPARSTEYLRPMPFLCTPTRGLCHISDVRVQSPPQGLCHIPDVSVQSRSHYRAVPTPRPACGVDPPPQAPHLLGVCQKAGGSGMGLSPCWVPSYAV

SEQ ID NO: 849194 - protein, 142 aa, Homo sapiens
MLSCCLEPAAWDCGAEGRDGREEMVLGWKRDRGTTPRTLPASPSAGTPLWGAGHVLGDAGESPLPSHPCPNRWSCCWSRKSCGVLAGWRCGSEAAPLTQPPEVGGLRQDPGVRGNPSLPAPPQPVMRRLTFGPGPAPASDRP

SEQ ID NO: 849195 - protein, 238 aa, Homo sapiens
CGWVGGVGGRWGGGAGGGVGGAWSGGGGSASGQGVWAGWGVVAGGVVTGERYKAEPRVGEFIVRRISGVAPHVCPVGDKKRGGARETGGDRGRLGRARVGGGGKVGGRGGGVWWGGGGGVVVWGGLVCFVFEGREEGLMSPVQGPSVGSLLLLALLLLALLLLLHFGLLGLARDALVLLGASSVGLHIRVRIAGAAAGVGRAVVSLLDGGAAVRRRPLPSPLKLEAFGPGPAPASDRP

SEQ ID NO: 849196 - protein, 318 aa, Homo sapiens
APLSSRGLTATCPPVHRACARVPPPSALRAARLPCTPSRRLSLLARSFLAVVGRSSGVFPALLARVLAPLSSRLFVVPPLFSSLCCLSLFSSASREPHISAGSPGFLRLFDRLPYVWSPPAVSPRVFLVSVGPWPSVWPLAPFFAPVFPPPRKKPPDFFFFFFFCCFFFFFFEGREEGLMSPVQGPSVGSLLLLALLLLALLLLLHFGLLGLARDALVLLGASSVGLHIRVRIAGAAAGVGRAVVSLLWTRTCPCLRPALNFVGTELGISPVARPHTGLLGGGLQGCSQVELHGGKRSWVLRPRAPGPCRGAEQGEER

SEQ ID NO: 849197 - protein, 146 aa, Homo sapiens
MSPVQGPSVGSLLLLALLLLALLLLLHFGLLGLARDALVLLGASSVGLHIRVRIAGAAAGVGRAVVSLLWTRTCPCLRPALNFVGTELGISPVARPHTGLLGGGLQGCGEKLGGWCRQLLGLSPAPCTSSPHSPGAHLLPGRTPWR

SEQ ID NO: 849198 - protein, 179 aa, Homo sapiens
ADFRPARAWMEAARRPRLGLSRRRPPPAGGPSGGRPWFLLGGDERERLWAELLRTVSPELILDHEVPSLPAFPGQEPRCGPEPTEVFTVGPKTFSWTPFPPDLWGPGRSYRLLHGAGGHLESPARSLPQRPAPDPCRAPRVEQQPSVEGAAALRSCPMCQKEFAPRYFNSRPHLCPAGS

SEQ ID NO: 849199 - protein, 155 aa, Homo sapiens
WHEVARGGHPFRRTCGARAVPTGCFTGQEGTWNPPPGPCPSARHLIPAGPPGWSSSRLWRVPRPCAAAPCARRSSPPGTSTPAPTCVPLAPKLPPYVWVASEMWGRRHSRKKGIRGASTSSEHFIPQDATRSLSWRSRSVHRVLFPWKMCTLETA

SEQ ID NO: 849200 - protein, 189 aa, Homo sapiens
ADFRPARAWMEAARRPRLGLSRRRPPPAGGPSGGRPWFLLGGDERERLWAELLRTVSPELILDHEVPSLPAFPGQEPRCGPEPTEVFTVGPKTFSWTPFPPDLWGPGRSYRLLHGAGGHLESPARSLPQRPAPDPCRAPRVEQQPSVEGAAALRSCPMCQKEFAPRLTQLDVDSHLAQCLAESTEDVTW

SEQ ID NO: 849201 - protein, 204 aa, Homo sapiens
ADFRPARAWMEAARRPRLGLSRRRPPPAGGPSGGRPWFLLGGDERERLWAELLRTVSPELILDHEVPSLPAFPGQEPRCGPEPTEVFTVGPKTFSWTPFPPDLWGPGRSYRLLHGAGGHLESPARSLPQRPAPDPCRAPRVEQQPSVEGAAALRSCPMCQKEFAPRSKNSSGMRRHRSPKLAANNNNNKRKGRARWLTPVIPAL

SEQ ID NO: 849202 - protein, 110 aa, Homo sapiens
MFFVSLKKTTSTKQTRKNNKEKQQKRGGPQKKLQRGRQYKDTQIVEQEGPNKEAHYIERNRGRSYTTARGDTTAKRDHWETQPTRRGGTKCAKHHREVNAGREKQTEEHR

SEQ ID NO: 849203 - protein, 204 aa, Homo sapiens; identical to SEQ ID NO: 849201

SEQ ID NO: 849204 - protein, 116 aa, Homo sapiens
MRIKAGRAPVCLCVVMKKKKKAGDTTQGHATRATHPEQREQADRRERAPRRHGHRRGEKGRTKEGRTDAAKQNRRGEQDEGRRRERKTQEGKERGKGERRAKREKRAREEGGKERN

SEQ ID NO: 849205 - protein, 57 aa, Homo sapiens
MTGRGKNSHKHGNKTQTATRNTEHERKREKNGRTHKEKKKKRQKNEEQGEKERKKDK

SEQ ID NO: 849206 - protein, 158 aa, Homo sapiens
RTSAGAGLDGGGAEAAAGVEPPEAAPGGREPRCGPEPTEVFTVGPKTFSWTPFPPDLWGPGRSYRLLHGAGGHLESPARSLPQRPAPDPCRAPRVEQQPSVEGAAALRSCPMCQKEFAPRSKNSSGMRRHRSPKLAANNNNNKRKGRARWLTPVIPAL

SEQ ID NO: 849207 - protein, 189 aa, Homo sapiens; identical to SEQ ID NO: 849200

SEQ ID NO: 849208 - protein, 161 aa, Homo sapiens
TRPPTRPGGGAEPSGGRPWFLLGGDERERLWAELLRTVSPELILDHEVPSLPAFPGQEPRCGPEPTEVFTVGPKTFSWTPFPPDLWGPGRSYRLLHGAGGHLESPARSLPQRPAPDPCRAPRVEQQPSVEGAAALRSCPMCQKEFAPRYFNSRPHLCPAGS

SEQ ID NO: 849209 - protein, 44 aa, Homo sapiens
MTQTATRNTEHERKREKNGRTHKEKKKKRLKNEEQGEKERKKDK

SEQ ID NO: 849210 - protein, 110 aa, Homo sapiens; identical to SEQ ID NO: 849202

SEQ ID NO: 849211 - protein, 116 aa, Homo sapiens; identical to SEQ ID NO: 849204

SEQ ID NO: 849212 - protein, 204 aa, Homo sapiens; identical to SEQ ID NO: 849201

SEQ ID NO: 849213 - protein, 143 aa, Homo sapiens
RTSAGAGLDGGGAEAAAGVEPPEAAPGGREPRCGPEPTEVFTVGPKTFSWTPFPPDLWGPGRSYRLLHGAGGHLESPARSLPQRPAPDPCRAPRVEQQPSVEGAAALRSCPMCQKEFAPRLTQLDVDSHLAQCLAESTEDVTW

SEQ ID NO: 849214 - protein, 401 aa, Homo sapiens
APAAPAVPAVPAAPAAPAAAATAAAQPPADCMFQASMRSPNMEPFKQQKVEDFYDIGEELGSGQFAIVKKCREKSTGLEYAAKFIKKRQSRASRRGVSREEIEREVSILRQVLHHNVITLHDVYENRTDVVLILELVSGGELFDFLAQKESLSEEEATSFIKQILDGVNYLHTKKIAHFDLKPENIMLLDKNIPIPHIKLIDFGLAHEIEDGVEFKNIFGTPEFVAPEIVNYEPLGLEADMWSIGVITYILLSGASPFLGDTKQETLANITAVSYDFDEEFFSQTSELAKDFIRKLLVKETRKRLTIQEALRHPWITPVDNQQAMVRRESVVNLENFRKQYVRRRWKLSFSIVSLCNHLTRSLMKKVHLRPDEDLRNCESDTEEDIARRKALHPRRRSSTS

SEQ ID NO: 849215 - protein, 370 aa, Homo sapiens
MFQASMRSPNMEPFKQQKVEDFYDIGEELGSGQFAIVKKCREKSTGLEYAAKFIKKRQSRASRRGVSREEIEREVSILRQVLHHNVITLHDVYENRTDVVLILELVSGGELFDFLAQKESLSEEEATSFIKQILDGVNYLHTKKIAHFDLKPENIMLLDKNIPIPHIKLIDFGLAHEIEDGVEFKNIFGTPEFVAPEIVNYEPLGLEADMWSIGVITYILLSGASPFLGDTKQETLANITAVSYDFDEEFFSQTSELAKDFIRKLLVKETRKRLTIQEALRHPWITPVDNQQAMVRRESVVNLENFRKQYVRRRWKLSFSIVSLCNHLTRSLMKKVHLRPDEDLRNCESDTEEDIARRKALHPRRRSSTS

SEQ ID NO: 849216 - protein, 370 aa, Homo sapiens; identical to SEQ ID NO: 849215

SEQ ID NO: 849217 - protein, 160 aa, Homo sapiens [sequence omitted]

SEQ ID NO: 849218 - protein, 178 aa, Homo sapiens
STPHRCPHLTGSPTPHRCPTPHRESHTCTGSPTPAPGDTKQETLANITAVSYDFDEEFFSQTSELAKDFIRKLLVKETRKRLTIQEALRHPWITPVDNQQAMVRRESVVNLENFRKQYVRRRWKLSFSIVSLCNHLTRSLMKKVHLRPDEDLRNCESDTEEDIARRKALHPRRRSSTS

SEQ ID NO: 849219 - protein, 675 aa, Homo sapiens
MAAAKVALTKRADPAELRTIFLKYASIEKNGEFFMSPNDFVTRYLNIFGESQPNPKTVELLSGVVDQTKDGLISFQEFVAFESVLCAPDALFMVAFQLFDKAGKGEVTFEDVKQVFGQTTIHQHIPFNWDSEFVQLHFGKERKRHLTYAEFTQFLLEIQLEHAKQAFVQRDNARTGRVTAIDFRDIMVTIRPHVLTPFVEECLVAAAGGTTSHQVSFSYFNGFNSLLNNMELIRKIYSTLAGTRKDVEVTKEEFVLAAQKFGQVTPMEVDILFQLADLYEPRGRMTLADIERIAPLEEGTLPFNLAEAQRQKASGDSARPVLLQVAESAYRFGLGSVAGAVGATAVYPIDLVKTRMQNQRSTGSFVGELMYKNSFDCFKKVLRYEGFFGLYRGLLPQLLGVAPEKAIKLTVNDFVRDKFMHKDGSVPLAAEILAGGCAGGSQVIFTNPLEIVKIRLQVAGEITTGPRVSALSVVRDLGFFGIYKGAKACFLRDIPFSAIYFPCYAHVKASFANEDGQVSPGSLLLAGAIAGMPAASLVTPADVIKTRLQVAARAGQTTYSGVIDCFRKILREEGPKALWKGAGARVFRSSPQFGVTLLTYELLQRWFYIDFGGVKPMGSEPVPKSRINLPAPNPDHVGGYKLAVATFAGIENKFGLYLPLFKPSVSTSKAIGGGP

SEQ ID NO: 849220 - protein, 583 aa, Homo sapiens [sequence omitted]

SEQ ID NO: 849221 - protein, 628 aa, Homo sapiens
MAAAKVALTKRADPAELRTIFLKYASIEKNGEFFMSPNDFVTRYLNIFGESQPNPKTVELLSGVVDQTKDGLISFQEFVAFESVLCAPDALFMVAFQLFDKAGKGEVTFEDVKQVFGQTTIHQHIPFNWDSEFVQLHFGKERKRHLTYAEFTQFLLEIQLEHAKQAFVQRDNARTGRVTAIDFRDIMVTIRPHVLTPFVEECLVAAAGGTTSHQVSFSYFNGFNSLLNNMELIRKIYSTLAGTRKDVEVTKEEFVLAAQKFGQVTPMEVDILFQLADLYEPRGRMTLADIERIAPLEEGTLPFNLAEAQRQKASGDSARPVLLQVAESAYRFGLGSVAGAVGATAVYPIDLVKTRMQNQRSTGSFVGELMYKNSFDCFKKVLRYEGFFGLYRGLLPQLLGVAPEKAIKLTVNDFVRDKFMHKDGSVPLAAEILAGGCGAKACFLRDIPFSAIYFPCYAHVKASFANEDGQVSPGSLLLAGAIAGMPAASLVTPADVIKTRLQVAARAGQTTYSGVIDCFRKILREEGPKALWKGAGARVFRSSPQFGVTLLTYELLQRWFYIDFGGVKPMGSEPVPKSRINLPAPNPDHVGGYKLAVATFAGIENKFGLYLPLFKPSVSTSKAIGGGP

SEQ ID NO: 849222 - protein, 393 aa, Homo sapiens
MAAAKVALTKRADPAELRTIFLKYASIEKNGEFFMSPNDFVTRYLNIFGESQPNPKTVELLSGVVDQTKDGLISFQEFVAFESVLCAPDALFMVAFQLFDKAGKGEVTFEDVKQVFGQTTIHQHIPFNWDSEFVQLHFGKERKRHLTYAEFTQFLLEIQLEHAKQAFVQRDNARTGRVTAIDFRDIMVTIRPHVLTPFVEECLVAAAGGTTSHQVSFSYFNGFNSLLNNMELIRKIYSTLAGTRKDVEVTKEEFVLAAQKFGQVTPMEVDILFQLADLYEPRGRMTLADIERIAPLEEGTLPFNLAEAQRQKASGDSARPVLLQVAESAYRFGLGSVAGAVGATAVYPIDLVKTRMQNQRSTGSFVGELMYKNSFDCFKKVLRYEGFFGLYRG

SEQ ID NO: 849223 - protein, 400 aa, Homo sapiens
MAAAKVALTKRADPAELRTIFLKYASIEKNGEFFMSPNDFVTRYLNIFGESQPNPKTVELLSGVVDQTKDGLISFQEFVAFESVLCAPDALFMVAFQLFDKAGKGEVTFEDVKQVFGQTTIHQHIPFNWDSEFVQLHFGKERKRHLTYAEFTQFLLEIQLEHAKQAFVQRDNARTGRVTAIDFRDIMVTIRPHVLTPFVEECLVAAAGGTTSHQVSFSYFNGFNSLLNNMELIRKIYSTLAGTRKDVEVTKEEFVLAAQKFGQVTPMEVDILFQLADLYEPRGRMTLADIERIAPLEEGTLPFNLAEAQRQKASGDSARPVLLQVAESAYRFGLGSVAGAVGATAVYPIDLVKTRMQNQRSTGSFVGELMYKNSFDCFKKVLRYEGFFGLYRGLLPHVFA

SEQ ID NO: 849224 - protein, 675 aa, Homo sapiens; identical to SEQ ID NO: 849219

SEQ ID NO: 849225 - protein, 675 aa, Homo sapiens; identical to SEQ ID NO: 849219

SEQ ID NO: 849226 - protein, 694 aa, Homo sapiens
MAAAKVALTKRADPAELRTIFLKYASIEKNGEFFMSPNDFVTRYLNIFGESQPNPKTVELLSGVVDQTKDGLISFQEFVAFESVLCAPDALFMVAFQLFDKAGKGEVTFEDVKQVFGQTTIHQHIPFNWDSEFVQLHFGKERKRHLTYAEFTQFLLEIQLEHAKQAFVQRDNARTGRVTAIDFRDIMVTIRPHVLTPFVEECLVAAAGGTTSHQVSFSYFNGFNSLLNNMELIRKIYSTLAGTRKDVEVTKEEFVLAAQKFGQVTPMEVDILFQLADLYEPRGRMTLADIERIAPLEEGTLPFNLAEAQRQKASGDSARPVLLQVAESAYRFGLGSVAGAVGATAVYPIDLVKTRMQNQRSTGSFVGELMYKNSFDCFKKVLRYEGFFGLYRGLLPQLLGVAPEKAIKLTVNDFVRDKFMHKDGSVPLAAEILAGGCGCSCGSSDGDLDLQSSLHEAGGSQVIFTNPLEIVKIRLQVAGEITTGPRVSALSVVRDLGFFGIYKGAKACFLRDIPFSAIYFPCYAHVKASFANEDGQVSPGSLLLAGAIAGMPAASLVTPADVIKTRLQVAARAGQTTYSGVIDCFRKILREEGPKALWKGAGARVFRSSPQFGVTLLTYELLQRWFYIDFGGVKPMGSEPVPKSRINLPAPNPDHVGGYKLAVATFAGIENKFGLYLPLFKPSVSTSKAIGGGP

SEQ ID NO: 849227 - protein, 609 aa, Homo sapiens
MAAAKVALTKRADPAELRTIFLKYASIEKNGEFFMSPNDFVTRYLNIFGESQPNPKTVELLSGVVDQTKDGLISFQEFVAFESVLCAPDALFMVAFQLFDKAGKGEVTFEDVKQVFGQTTIHQHIPFNWDSEFVQLHFGKERKRHLTYAEFTQFLLEIQLEHAKQAFVQRDNARTGRVTAIDFRDIMVTIRPHVLTPFVEECLVAAAGGTTSHQVSFSYFNGFNSLLNNMELIRKIYSTLAGTRKDVEVTKEEFVLAAQKFGQVTPMEVDILFQLADLYEPRGRMTLADIERIAPLEEGTLPFNLAEAQRQKASGDSARPVLLQVAESAYRFGLGSVAGAVGATAVYPIDLVKTRMQNQRSTGSFVGELMYKNSFDCFKKVLRYEGFFGLYRGLLPQLLGVAPEKAIKLTVNDFVRDKFMHKDGSVPLAAEILAGGCGCSCGSSDGDLDLQSSLHEAGGSQVIFTNPLEIVKIRLQVAGEITTGPRVSALSVVRDLGFFGIYKGAKACFLRDIPFSAIYFPCYAHVKASFANEDGQVSPGSLLLAGAIAGMPAASLVTPADVIKTRLQVAARAGQTTYSGVIDCFRKILREEGPKALWKGAGGMEIMCS

SEQ ID NO: 849228 - protein, 156 aa, Homo sapiens
MERHQPRLHHSGRGPWSSCAVEQLPKRDHYQVSAGTRFRSVSVQEHKLIRKTLQIVAKTSNQGPLVVYRPITHLFVKTKLKGYLKGYSKVSAHVQTMVKLSEDKPKETKSEEETLDEGPPKYTKSVLTREDKTNFPKREMWSLWYREHYKMGLFGY

SEQ ID NO: 849229 - protein, 875 aa, Homo sapiens
MERHQPRLHHPAQGSAAGTPYPSSASLRGCRESKMPRRKGPQHPPPPSGPEEPGEKRPKFHLNIRTLTDDMLDKFASIRIPGSKKERPPLPNLKTAFASSDCSAAPLEMMENFPKPLSENELLELFEKMMEDMNLNEDKKAPLREKDFSIKKEMVMQYINTASKTGSLKRSRQISPQEFIHELKMGSADERLVTCLESLRVSLTSNPVSWVESFGHEGLGLLLDILEKLISGKIQEKVVKKNQHKVIQCLKALMNTQYGLERIMSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVNRKCSCTEGSRSHYNINCNSTRTPVAKELNYNLDTHTSTGRIKAAEKKEACNVESNRKKETELLGSFSKNESVPEVEALLARLRAL

SEQ ID NO: 849230 - protein, 105 aa, Homo sapiens
SIFHVLYYVTQDRHAQGNQNRKCSCTEGSRSHYNINCNSTRTPVAKELNYNLDTHTSTGRIKAAEKKEACNVESNRKKETELLGSFSKNESVPEVEALLARLRAL

SEQ ID NO: 849231 - protein, 104 aa, Homo sapiens
SYLFLFSTFPFMVRIHKTNRKCSCTEGSRSHYNINCNSTRTPVAKELNYNLDTHTSTGRIKAAEKKEACNVESNRKKETELLGSFSKNESVPEVEALLARLRAL

SEQ ID NO: 849232 - protein, 1112 aa, Homo sapiens
MERHQPRLHHPAQGSAAGTPYPSSASLRGCRESKMPRRKGPQHPPPPSGPEEPGEKRPKFHLNIRTLTDDMLDKFASIRIPGSKKERPPLPNLKTAFASSDCSAAPLEMMENFPKPLSENELLELFEKMMEDMNLNEDKKAPLREKDFSIKKEMVMQYINTASKTGSLKRSRQISPQEFIHELKMGSADERLVTCLESLRVSLTSNPVSWVESFGHEGLGLLLDILEKLISGKIQEKVVKKNQHKVIQCLKALMNTQYGLERIMSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVMSNVKRLRPRLSAILFKLQFEEQVNNIKPDIMAVSTACEEIKKSKSFSKLLELVLLMGNYMNAGSRNAQTFGFNLSSLCKLKDTKSADQKTTLLHFLVEICEEKYPDILNFVDDLEPLDKASKVSVETLEKNLRQMGRQLQQLEKELETFPPPEDLHDKFVTKMSRFVISAKEQYETLSKLHENMEKLYQSIIGYYAIDVKKVSVEDFLTDLNNFRTTFMQAIKENIKKREAEEKEKRVRIAKELAERERLERQQKKKRLLEMKTEGDETGVMDNLLEALQSGAAFRDRRKRTPMPKDVRQSLSPMSQRPVLKVCNHGNKPYL

SEQ ID NO: 849233 - protein, 691 aa, Homo sapiens
MSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVMSNVKRLRPRLSAILFKLQFEEQVNNIKPDIMAVSTACEEIKKSKSFSKLLELVLLMGNYMNAGSRNAQTFGFNLSSLCKLKDTKSADQKTTLLHFLVEICEEKYPDILNFVDDLEPLDKASKGLCLFKKHFMALIFSAKRLKIIPFICMYFPLSHSVFIPNISF

SEQ ID NO: 849234 - protein, 875 aa, Homo sapiens; identical to SEQ ID NO: 849229

SEQ ID NO: 849235 - protein, 103 aa, Homo sapiens
CPAGGDARLETRGRLEVHRKCSCTEGSRSHYNINCNSTRTPVAKELNYNLDTHTSTGRIKAAEKKEACNVESNRKKETELLGSFSKNESVPEVEALLARLRAL

SEQ ID NO: 849236 - protein, 875 aa, Homo sapiens; identical to SEQ ID NO: 849229

SEQ ID NO: 849237 - protein, 824 aa, Homo sapiens
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQIRILKSPQEVKPGEKHYNMAKSYPNEEKDAWDVKMLLEQFSFDIAEEASKVCLAHLFTYQDFDMGTLGLAYVGSPRANSHGGVCPKAYYSPVGKKNIYLNSGLTSTKNYGKTILTKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNETDNSCKVCCRDLSGRCVPYVDAEQKNLFLRKGKPCTVGFCDMNGKCEKRVQDVIERFWDFIDQLSINTFGKFLADNIVGSVLVFSLIFWIPFSILVHCVDKKLDKQYESLSLFHPSNVEMLSSMDSASVRIIKPFPAPQTPGRLQPAPVIPSAPAAPKLDHQRMDTIQEDPSTDSHMDEDGFEKDPFPNSSTAAKSFEDLTDHPVTRSEKAASFKLQRQNRVDSKETEC

SEQ ID NO: 849238 - protein, 807 aa, Homo sapiens
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQIRILKSPQEVKPGEKHYNMAKSYPNEEKDAWDVKMLLEQFSFDIAEEASKVCLAHLFTYQDFDMGTLGLAYVGSPRANSHGGVCPKAYYSPVGKKNIYLNSGLTSTKNYGKTILTKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNETDNSCKVCCRDLSGRCVPYVDAEQKNLFLRKGKPCTVGFCDMNGKCEKRVQDVIERFWDFIDQLSINTFGKFLADNIVGSVLVFSLIFWIPFSILVHCVNVEMLSSMDSASVRIIKPFPAPQTPGRLQPAPVIPSAPAAPKLDHQRMDTIQEDPSTDSHMDEDGFEKDPFPNSSTAAKSFEDLTDHPVTRSEKAASFKLQRQNRVDSKETEC

SEQ ID NO: 849239 - protein, 824 aa, Homo sapiens; identical to SEQ ID NO: 849237

SEQ ID NO: 849240 - protein, 383 aa, Homo sapiens
MILKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNETDNSCKVCCRDLSGRCVPYVDAEQKNLFLRKGKPCTVGFCDMNGKCEKRVQDVIERFWDFIDQLSINTFGKFLADNIVGSVLVFSLIFWIPFSILVHCVDKKLDKQYESLSLFHPSVSIPYERNIIFAWSEALLGKDLHLTQQELSLADGRSCCSRKGLGWNVYPSDNSDGELRLVAWMDI

SEQ ID NO: 849241 - protein, 631 aa, Homo sapiens
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQIRILKSPQEVKPGEKHYNMAKSYPNEEKDAWDVKMLLEQFSFDIAEEASKVCLAHLFTYQDFDMGTLGLAYVGSPRANSHGGVCPKAYYSPVGKKNIYLNSGLTSTKNYGKTILTKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNGEQFYSQSSSRRKHGLCLPGSLPPFGGCANDSSGEIQ

SEQ ID NO: 849242 - protein, 70 aa, Homo sapiens
NKCDFLPLWEHGQGGKRRQEERQVSEQSSCQCVFSVPETDNSCKVCCRDLSGRCVPYVDALRIDNFEFCR

SEQ ID NO: 849243 - protein, 824 aa, Homo sapiens; identical to SEQ ID NO: 849237

SEQ ID NO: 849244 - protein, 824 aa, Homo sapiens; identical to SEQ ID NO: 849237

SEQ ID NO: 849245 - protein, 776 aa, Homo sapiens
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQIRILKSPQEVKPGEKHYNMAKSYPNEEKDAWDVKMLLEQFSFDIAEEASKVCLAHLFTYQDFDMGTLGLAYVGSPRANSHGGVCPKAYYSPVGKKNIYLNSGLTSTKNYGKTILTKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNETDNSCKVCCRDLSGRCVPYVDAEQKNLFLRKGKPCTVGFCDMNGKCEKRVQDVIERFWDFIDQLSINTFGKFLADNIVGSVLVFSLIFWIPFSILVHCVDKKLDKQYESLSLFHPSVSIPYERNIIFAWSEALLGKDLHLTQQELSLADGRSCCSRKGLGWNVYPSDNSDGELRLVAWMDI

SEQ ID NO: 849246 - protein, 110 aa, Homo sapiens [sequence omitted]

SEQ ID NO: 849247 - protein, 314 aa, Homo sapiens
MAATASAGAGGIDGKPRTSPKSVKFLFGGLAGMGATVFVQPLDLVKNRMQLSGEGAKTREYKTSFHALTSILKAEGLRGIYTGLSAGLLRQATYTTTRLGIYTVLFERLTGADGTPPGFLLKAVIGMTAGATGAFVGTPAEVALIRMTADGRLPADQRRGYKNVFNALIRITREEGVLTLWRGCIPTMARAVVVNAAQLASYSQSKQFLLDSGYFSDNILCHFCASMISGLVTTAASMPVDIAKTRIQNMRMIDGKPEYKNGLDVLFKVVRYEGFFSLWKGFTPYYARLGPHTVLTFIFLEQMNKAYKRLFLSG

SEQ ID NO: 849248 - protein, 314 aa, Homo sapiens; identical to SEQ ID NO: 849247

SEQ ID NO: 849249 - protein, 314 aa, Homo sapiens; identical to SEQ ID NO: 849247

SEQ ID NO: 849250 - protein, 314 aa, Homo sapiens; identical to SEQ ID NO: 849247

SEQ ID NO: 849251 - protein, 282 aa, Homo sapiens [sequence omitted]

SEQ ID NO: 849252 - protein, 342 aa, Homo sapiens
MAATASAGAGGIDGKPRTSPKSVKFLFGGLAGMGATVFVQPLDLVKNRMQLSGEGAKTREYKTSFHALTSILKAEGLRGIYTGYWGLRMEGRLWVGSSRPWPDMLTPLLLRLSAGLLRQATYTTTRLGIYTVLFERLTGADGTPPGFLLKAVIGMTAGATGAFVGTPAEVALIRMTADGRLPADQRRGYKNVFNALIRITREEGVLTLWRGCIPTMARAVVVNAAQLASYSQSKQFLLDSGYFSDNILCHFCASMISGLVTTAASMPVDIAKTRIQNMRMIDGKPEYKNGLDVLFKVVRYEGFFSLWKGFTPYYARLGPHTVLTFIFLEQMNKAYKRLFLSG

SEQ ID NO: 849253 - protein, 263 aa, Homo sapiens
MAATASAGAGGIDGKPRTSPKSVKFLFGGLAGLSAGLLRQATYTTTRLGIYTVLFERLTGADGTPPGFLLKAVIGMTAGATGAFVGTPAEVALIRMTADGRLPADQRRGYKNVFNALIRITREEGVLTLWRGCIPTMARAVVVNAAQLASYSQSKQFLLDSGYFSDNILCHFCASMISGLVTTAASMPVDIAKTRIQNMRMIDGKPEYKNGLDVLFKVVRYEGFFSLWKGFTPYYARLGPHTVLTFIFLEQMNKAYKRLFLSG

SEQ ID NO: 849254 - protein, 360 aa, Homo sapiens
MAATASAGAGGIDGKPRTSPKSVKFLFGGLAGMGATVFVQPLDLVKNRMQLSGEGAKTREYKTSFHALTSILKAEGLRGIYTGLSAGLLRQATYTTTRLGIYTVLFERLTGADGTPPGFLLKAVIGMTAGATGAFVGTPAEVALIRMTADGRLPADQRRGYKNVFNALIRITREEGVLTLWRGCIPTMARAVVVNAAQLASYSQSKQFLLDSGYFSDNILCHFCASMISGLVTTAASMPVDIAKTRIQNMRMIDESRRQTGWPSVKCAYEASSPVEGFTLYAAVPQIVSTHPRGRLTSLKRLSRVSAGLLRGLAGRGWSVLPHISRVLWKWVPFSLAADRGLGTVPLCSKPARHSGPPRL

SEQ ID NO: 849255 - protein, 302 aa, Homo sapiens
MAATASAGAGGIDGKPRTSPKSVKFLFGGLAGMGATVFVQPLDLVKNRMQLSGEGAKTREYKTSFHALTSILKAEGLRGIYTGLSAGLLRQATYTTTRLGIYTVLFERLTGADGTPPGFLLKAVIGMTAGATGAFVGTPAEVALIRMTADGRLPADQRRGYKNVFNALIRITREEGVLTLWRGCIPTMARAVVVNAAQLASYSQSKQFLLDSGEIQSWALSSQPGLATSELTATPASPPPGYFSDNILCHFCASMISGLVTTAASMPVDIAKTRIQEASDGMIDGKPEYKNGLDVASVRVPS

SEQ ID NO: 849256 - protein, 314 aa, Homo sapiens; identical to SEQ ID NO: 849247

SEQ ID NO: 849257 - protein, 314 aa, Homo sapiens; identical to SEQ ID NO: 849247

SEQ ID NO: 849258 - protein, 314 aa, Homo sapiens; identical to SEQ ID NO: 849247

SEQ ID NO: 849259 - protein, 282 aa, Homo sapiens [sequence omitted]

SEQ ID NO: 849260 - protein, 267 aa, Homo sapiens
MRGWFVLSSLGPFPAFRILVRAWKLKAEGLRGIYTGLSAGLLRQATYTTTRLGIYTVLFERLTGADGTPPGFLLKAVIGMTAGATGAFVGTPAEVALIRMTADGRLPADQRRGYKNVFNALIRITREEGVLTLWRGCIPTMARAVVVNAAQLASYSQSKQFLLDSGYFSDNILCHFCASMISGLVTTAASMPVDIAKTRIQNMRMIDGKPEYKNGLDVLFKVVRYEGFFSLWKGFTPYYARLGPHTVLTFIFLEQMNKAYKRLFLSG

SEQ ID NO: 849261 - protein, 192 aa, Homo sapiens
MAATASAGAGGIDGKPRTSPKSVKFLFGGLAGMGATVFVQPLDLVKNRMQLSGEGAKTREYKTSFHALTSILKAEGLRGIYTGLSAGLLRQATYTTTRLGIYTVLFERLTGADGTPPGFLLKAVIGMTAGATGAFVGTPAEVALIRMTADGRLPADQRRGYKNVFNAPGGLGSAALDPSIYFPSTVWFLPLR

SEQ ID NO: 849262 - protein, 120 aa, Homo sapiens
LRRSGASSPPGPRGGGFPPSLLSASSRCARISLGLAQGPRWRRVFFSNHRAPLFKSSQSTFVSFLQKEKHLSCCGKGPQRPLVTDRAIAVRSGHFFQDTFCLHDRNIEKPRLVAGLLMDY

SEQ ID NO: 849263 - protein, 108 aa, Homo sapiens
MQEDDCRFSAARVREAMRWKSHPTMGRTWRQGSPCLCPREATLQERVSEFHELGEHSKPIQNMLTHREVSQVGTSSINETRMLNIYTEFSFCLDDYQNKISVYEKPYE

SEQ ID NO: 849264 - protein, 111 aa, Homo sapiens
PSEAGGTGSNRCRLRGNWDFSPGSWRTRPPTLPPPHASETGSRALSRFRAPRGESEVRVIRAAPPSQEPQLNQRFPLHQPLRPGHFFQDTFCLHDRNIEKPRLVAGLLMDY

SEQ ID NO: 849265 - protein, 113 aa, Homo sapiens
MAGKKVLIVYAHQEPKSFNGSLKNVAVDELSRQGCTVTVSDLYAMNFEPRATDKDITGTLSNPEVFNYGVETHEAYKQRSLASDITDEQKGCQASWRADGLGSCAGLLPLQST

SEQ ID NO: 849266 - protein, 231 aa, Homo sapiens
MAGKKVLIVYAHQEPKSFNGSLKNVAVDELSRQGCTVTVSDLYAMNFEPRATDKDITGTLSNPEVFNYGVETHEAYKQRSLASDITDEQKKVREADLVIFQFPLYWFSVPAILKGWMDRVLCQGFAFDIPGFYDSGLLQGKLALLSVTTGGTAEMYTKTGVNGDSRYFLWPLQHGTLHFCGFKVLAPQISFAPEIASEEERKGMVAAWSQRLQTIWKEEPIPCTAHWHFGQ

SEQ ID NO: 849267 - protein, 231 aa, Homo sapiens; identical to SEQ ID NO: 849266

SEQ ID NO: 849268 - protein, 231 aa, Homo sapiens; identical to SEQ ID NO: 849266

SEQ ID NO: 849269 - protein, 329 aa, Homo sapiens
QGFQLAGHMALWVVAPGPGTILYIGSCLALTERAHTQGPGVESSGGICPQPYGAGAGIIVILQVGISGPKLLDSLKRDYAGKPQPPIKSERRNPPSYAMAGKKVLIVYAHQEPKSFNGSLKNVAVDELSRQGCTVTVSDLYAMNFEPRATDKDITGTLSNPEVFNYGVETHEAYKQRSLASDITDEQKKVREADLVIFQFPLYWFSVPAILKGWMDRVLCQGFAFDIPGFYDSGLLQGKLALLSVTTGGTAEMYTKTGVNGDSRYFLWPLQHGTLHFCGFKVLAPQISFAPEIASEEERKGMVAAWSQRLQTIWKEEPIPCTAHWHFGQ

SEQ ID NO: 849270 - protein, 231 aa, Homo sapiens; identical to SEQ ID NO: 849266

SEQ ID NO: 849271 - protein, 231 aa, Homo sapiens; identical to SEQ ID NO: 849266

SEQ ID NO: 849272 - protein, 330 aa, Homo sapiens
SADTSLAISTARQPRKCSAYLYTWIPGINSGLLDSLKRDYAGKPQPPIKSERRNPPSYAMAEFRFLKSGALPILSLLCLQALKFSLGCSRGSSERTPGGILGKKVLIVYAHQEPKSFNGSLKNVAVDELSRQGCTVTVSDLYAMNFEPRATDKDITGTLSNPEVFNYGVETHEAYKQRSLASDITDEQKKVREADLVIFQFPLYWFSVPAILKGWMDRVLCQGFAFDIPGFYDSGLLQGKLALLSVTTGGTAEMYTKTGVNGDSRYFLWPLQHGTLHFCGFKVLAPQISFAPEIASEEERKGMVAAWSQRLQTIWKEEPIPCTAHWHFGQ

SEQ ID NO: 849273 - protein, 146 aa, Homo sapiens
MEWKPTKPTSKGLWLATSLMSRNVPAILKGWMDRVLCQGFAFDIPGFYDSGLLQGKLALLSVTTGGTAEMYTKTGVNGDSRYFLWPLQHGTLHFCGFKVLAPQISFAPEIASEEERKGMVAAWSQRLQTIWKEEPIPCTAHWHFGQ

SEQ ID NO: 849274 - protein, 193 aa, Homo sapiens [sequence omitted]

SEQ ID NO: 849275 - protein, 67 aa, Homo sapiens
VGEAGLEGDGAALPDEQRKRQGESQAQCGMSHRQQGMDSGKKGRRAGKDLHRGCELSCTQTKAARGS

SEQ ID NO: 849276 - protein, 164 aa, Homo sapiens
MAGKKVLIVYAHQEPKSFNGSLKNVAVDELSRQGCTVTVSDLYAMNFEPRATDKDITGTLSNPEVFNYGVETHEAYKQRSLASDITDEQKKVREADLVIFQVCFSLINILNQIHLMYKLFLNIEFCAASGSGINVLSTVAHLLSKYCNLVTTPSYNISPSYTTS

SEQ ID NO: 849277 - protein, 164 aa, Homo sapiens; identical to SEQ ID NO: 849276

SEQ ID NO: 849278 - protein, 163 aa, Homo sapiens
MDVTSPTFSGAVMYLKHSKGTWPGWSPLLSTHLTSCSILQTPALCLCSWTAGDKEWALEDAHSGPAQDSSPGGDKHHFCVSLCFLFCCKDTLIGSRCRLDTTCAMRVFTLSPSHTLCIVFLSHFFLLWYRTSHIKLTILTTFFVCLFFVFLDRVSLCLSYSGG

SEQ ID NO: 849279 - protein, 231 aa, Homo sapiens; identical to SEQ ID NO: 849266

SEQ ID NO: 849280 - protein, 231 aa, Homo sapiens; identical to SEQ ID NO: 849266

SEQ ID NO: 849281 - protein, 231 aa, Homo sapiens; identical to SEQ ID NO: 849266

SEQ ID NO: 849282 - protein, 231 aa, Homo sapiens; identical to SEQ ID NO: 849266

SEQ ID NO: 849283 - protein, 231 aa, Homo sapiens; identical to SEQ ID NO: 849266

SEQ ID NO: 849284 - protein, 187 aa, Homo sapiens
MNFEPRATDKDITGTLSNPEVFNYGVETHEAYKQRSLASDITDEQKKVREADLVIFQFPLYWFSVPAILKGWMDRVLCQGFAFDIPGFYDSGLLQGKLALLSVTTGGTAEMYTKTGVNGDSRYFLWPLQHGTLHFCGFKVLAPQISFAPEIASEEERKGMVAAWSQRLQTIWKEEPIPCTAHWHFGQ

SEQ ID NO: 849285 - protein, 192 aa, Homo sapiens
MAGKKVLIVYAHQEPKSFNGSLKNVAVDELSRQGCTVTVSDLYAMNFEPRATDKDITGTLSNPEVFNYGVETHEAYKQRSLASDITDEQKKVREADLVIFQFPLYWFSVPAILKGWMDRVLCQGFAFDIPGFYDSGLLQGKLALLSVTTGGTAEMYTKTGVNGDSRYFLWPLQLVSSNKVMLSEAGCGGSRL

SEQ ID NO: 849286 - protein, 124 aa, Homo sapiens
MAGKKVLIVYAHQEPKSFNGSLKNVAVDELSRQGCTVTVSDLYAMNFEPRATDKDITGTLSNPEVFNYGVETHEAYKQRSLASDITDEQKHGRHGRDVHEDRSQWRFSILPVATPAWHITLLWI

SEQ ID NO: 849287 - protein, 112 aa, Homo sapiens
VGEAGLEGDGAALPDEQRKRQDALAYIKICIYGNVTGSPGYPKKGCFLLRGEANARNRKGVCQAVQAVFNGYGIGRSEINLACESWEVSESLSWRPSVVTALVGVLFSMRTG

SEQ ID NO: 849288 - protein, 89 aa, Homo sapiens
MAGKKVLIVYAHQEPKSFNGSLKNVAVDELSRQGCTVTVSDLYAMNFEPRATDKDITGTLFLIPEGFQLYGGGETPRKALTMPQGVLPG

SEQ ID NO: 849289 - protein, 1179 aa, Homo sapiens
AAATGPARAPQPAAAAASPRPGRRARRRERGLRRRPERWAQLGAERPVRRRPRASRTLPAMMPMILTVFLSNNEQILTEVPITPETTCRDVVEFCKEPGEGSCHLAEVWRGNGFREPSHKTYCTWPGTVAHSCNLNTLGGRERPIPFDHMMYEHLQKWGPRREEVKFFLRHEDSPTENSEQGGRQTQEQRTQRNVINVPGEKRTENGVGNPRVELTLSELQDMAARQQQQIENQQQMLVAKEQRLHFLKQQERRQQQSISENEKLQKLKERVEAQENKLKKIRAMRGQVDYSKIMNGNLSAEIERFSAMFQEKKQEVQTAILRVDQLSQQLEDLKKGKLNGFQSYNGKLTGPAAVELKRLYQELQIRNQLNQEQNSKLQQQKELLNKRNMEVAMMDKRISELRERLYGKKIQLNRVNGTSSPQSPLSTSGRVAAVGPYIQVPSAGSFPVLGDPIKPQSLSIASNAAHGRSKSANDGNWPTLKQNSSSSVKPVQVAGADWKDPSVEGSVKQGTVSSQPVPFSALGPTEKPGIEIGKVPPPIPGVGKQLPPSYGTYPSPTPLGPGSTSSLERRKEGSLPRPSAGLPSRQRPTLLPATGSTPQPGSSQQIQQRISVPPSPTYPPAGPPAFPAGDSKPELPLTVAIRPFLADKGSRPQSPRKGPQTVNSSSIYSMYLQQATPPKNYQPAAHSALNKSVKAVYGKPVLPSGSTSPSPLPFLHGSLSTGTPQPQPPSESTEKEPEQDGPAAPADGSTVESLPRPLSPTKLTPIVHSPLRYQSDADLEALRRKLANAPRPLKKRSSITEPEGPGGPNIQKLLYQRFNTLAGGMEGTPFYQPSPSQDFMGTLADVDNGNTNANGNLEELPPAQPTAPLPAEPAPSSDANDNELPSPEPEELICPQTTHQTAEPAEDNNNNVATVPTTEQIPSPVAEAPSPGEEQVPPAPLPPASHPPATSTNKRTNLKKPNSERTGHGLRVRFNPLALLLDASLEGEFDLVQRIIYEVEDPSKPNDEGITPLHNAVCAGHHHIVKFLLDFGVNVNAADSDGWTPLHCAASCNSVHLCKQLVESGAAIFASTISDIETAADKCEEMEEGYIQCSQFLYGVQEKLGVMNKGVAYALWDYEAQNSDELSFHEGDALTILRRKDESETEWWWARLGDREGYVPKNLLGLYPRIKPRQRTLA

SEQ ID NO: 849290 - protein, 978 aa, Homo sapiens
MPMILTVFLSNNEQILTEVPITPETTCRDVVEFCKEPGEGSCHLAEVWRGNERPIPFDHMMYEHLQKWGPRREEVKFFLRHEDSPTENSEQGGRQTQEQRTQRNVINVPGEKRTENGVGNPRVELTLSELQDMAARQQQQIENQQQMLVAKEQRLHFLKQQERRQQQSISENEKLQKLKERVEAQENKLKKIRAMRGQVDYSKIMNGNLSAEIERFSAMFQEKKQEVQTAILRVDQLSQQLEDLKKGKLNGFQSYNGKLTGPAAVELKRLYQELQIRNQLNQEQNSKLQQQKELLNKRNMEVAMMDKRISELRERLYGKKIQLNRVNGTSSPQSPLSTSGRVAAVGPYIQVPSAGSFPVLGDPIKPQSLSIASNAAHGRSKSANDGNWPTLKQNSSSSVKPVQVAGADWKDPSVEGSVKQGTVSSQPVPFSALGPTEKPGIEIGKVPPPIPGVGKQLPPSYGTYPSPTPLGPGSTSSLERRKEGSLPRPSAGLPSRQRPTLLPATGSTPQPGSSQQIQQRISVPPSPTYPPAGPPAFPAGDSKPELPLTVAIRPFLADKGSRPQSPRKGPQTVNSSSIYSMYLQQATPPKNYQPAAHSALNKSVKAVYGKPVLPSGSTSPSPLPFLHGSLSTGTPQPQPPSESTEKEPEQDGPAAPADGSTVESLPRPLSPTKLTPIVHSPLRYQSDADLEALRRKLANAPRPLKKRSSITEPEGPGGPNIQKLLYQRFNTLAGGMEGTPFYQPSPSQDFMGTLADVDNGNTNANGNLEELPPAQPTAPLPAEPAPSSDANDNELPSPEPEELICPQTTHQTAEPAEDNNNNVATVPTTEQIPSPVAEAPSPGEEQVPPAPLPPASHPPATSTNKRTNLKKPNSERTGHGLRVRFNPLALLLDASLEGEFDLVQRIIYEVEDPSKPNDEGITPLHNAVCAGHHHIVKFLLDFGVNVNAADSDGWGAGKAGCDEQRCGVCSVGLRGPEQ

SEQ ID NO: 849291 - protein, 905 aa, Homo sapiens
ELLTSGDPPTSASQSAGITDVSHRAQPSIFKVTFFFLLLGVVLTGSSGTGPRGRGRGGPVVARRGGGGGGGGGGGGGGGGGGGAGRGGGRRQQQSISENEKLQKLKERVEAQENKLKKIRAMRGQVDYSKIMNGNLSAEIERFSAMFQEKKQEVQTAILRVDQLSQQLEDLKKGKLNGFQSYNGKLTGPAAVELKRLYQELQIRNQLNQEQNSKLQQQKELLNKRNMEVAMMDKRISELRERLYGKKIQLNRVNGTSSPQSPLSTSGRVAAVGPYIQVPSAGSFPVLGDPIKPQSLSIASNAAHGRSKSANDGNWPTLKQNSSSSVKPVQVAGADWKDPSVEGSVKQGTVSSQPVPFSALGPTEKPGIEIGKVPPPIPGVGKQLPPSYGTYPSPTPLGPGSTSSLERRKEGSLPRPSAGLPSRQRPTLLPATGSTPQPGSSQQIQQRISVPPSPTYPPAGPPAFPAGDSKPELPLTVAIRPFLADKGSRPQSPRKGPQTVNSSSIYSMYLQQATPPKNYQPAAHSALNKSVKAVYGKPVLPSGSTSPSPLPFLHGSLSTGTPQPQPPSESTEKEPEQDGPAAPADGSTVESLPRPLSPTKLTPIVHSPLRYQSDADLEALRRKLANAPRPLKKRSSITEPEGPGGPNIQKLLYQRFNTLAGGMEGTPFYQPSPSQDFMGTLADVDNGNTNANGNLEELPPAQPTAPLPAEPAPSSDANDNELPSPEPEELICPQTTHQTAEPAEDNNNNVATVPTTEQIPSPVAEAPSPGEEQVPPAPLPPASHPPATSTNKRTNLKKPNSERTGHGLRVRFNPLALLLDASLEGEFDLVQRIIYEVEDPSKPNDEGITPLHNAVCAGHHHIVKFLLDFGVNVNAADSDGWGAGKAGCDEQRCGVCSVGLRGPEQ

SEQ ID NO: 849292 - protein, 760 aa, Homo sapiens
MFQEKKQEVQTAILRVDQLSQQLEDLKKGKLNGFQSYNGKLTGPAAVELKRLYQELQIRNQLNQEQNSKLQQQKELLNKRNMEVAMMDKRISELRERLYGKKIQLNRVNGTSSPQSPLSTSGRVAAVGPYIQVPSAGSFPVLGDPIKPQSLSIASNAAHGRSKSANDGNWPTLKQNSSSSVKPVQVAGADWKDPSVEGSVKQGTVSSQPVPFSALGPTEKPGIEIGKVPPPIPGVGKQLPPSYGTYPSPTPLGPGSTSSLERRKEGSLPRPSAGLPSRQRPTLLPATGSTPQPGSSQQIQQRISVPPSPTYPPAGPPAFPAGDSKPELPLTVAIRPFLADKGSRPQSPRKGPQTVNSSSIYSMYLQQATPPKNYQPAAHSALNKSVKAVYGKPVLPSGSTSPSPLPFLHGSLSTGTPQPQPPSESTEKEPEQDGPAAPADGSTVESLPRPLSPTKLTPIVHSPLRYQSDADLEALRRKLANAPRPLKKRSSITEPEGPGGPNIQKLLYQRFNTLAGGMEGTPFYQPSPSQDFMGTLADVDNGNTNANGNLEELPPAQPTAPLPAEPAPSSDANDNELPSPEPEELICPQTTHQTAEPAEDNNNNVATVPTTEQIPSPVAEAPSPGEEQVPPAPLPPASHPPATSTNKRTNLKKPNSERTGHGLRVRFNPLALLLDASLEGEFDLVQRIIYEVEDPSKPNDEGITPLHNAVCAGHHHIVKFLLDFGVNVNAADSDGWGAGKAGCDEQRCGVCSVGLRGPEQ

SEQ ID NO: 849293 - protein, 509 aa, Homo sapiens [sequence omitted]

SEQ ID NO: 849294 - protein, 104 aa, Homo sapiens [sequence omitted]

SEQ ID NO: 849295 - protein, 438 aa, Homo sapiens
MPMILTVFLSNNEQILTEVPITPETTCRDVVEFCKEPGEGSCHLAEVWRGNERPIPFDHMMYEHLQKWGPRREEVKFFLRHEDSPTENSEQGGRQTQEQRTQRNVINVPGEKRTENGVGNPRVELTLSELQDMAARQQQQIENQQQMLVAKEQRLHFLKQQERRQQQSISENEKLQKLKERVEAQENKLKKIRAMRGQVDYSKIMNGNLSAEIERFSAMFQEKKQEVQTAILRVDQLSQQLEDLKKGKLNGFQSYNGKLTGPAAVELKRLYQELQIRNQLNQEQNSKLQQQKELLNKRNMEVAMMDKRISELRERLYGKKIQLNRVNGTSSPQSPLSTSGRVAAVGPYIQVPSAGSFPVLGDPIKPQSLSIASNAAHGRSKSGEWSWPSSWGRVCEQGMGPAVEGRGVGQAPEALPHTSSDSRLSLPVRRLESCVPLW

SEQ ID NO: 849296 - protein, 1150 aa, Homo sapiens
AAATGPARAPQPAAAAASPRPGRRARRRERGLRRRPERWAQLGAERPVRRRPRASRTLPAMMPMILTVFLSNNEQILTEVPITPETTCRDVVEFCKEPGEGSCHLAEVWRGNERPIPFDHMMYEHLQKWGPRREEVKFFLRHEDSPTENSEQGGRQTQEQRTQRNVINVPGEKRTENGVGNPRVELTLSELQDMAARQQQQIENQQQMLVAKEQRLHFLKQQERRQQQSISENEKLQKLKERVEAQENKLKKIRAMRGQVDYSKIMNGNLSAEIERFSAMFQEKKQEVQTAILRVDQLSQQLEDLKKGKLNGFQSYNGKLTGPAAVELKRLYQELQIRNQLNQEQNSKLQQQKELLNKRNMEVAMMDKRISELRERLYGKKIQLNRVNGTSSPQSPLSTSGRVAAVGPYIQVPSAGSFPVLGDPIKPQSLSIASNAAHGRSKSANDGNWPTLKQNSSSSVKPVQVAGADWKDPSVEGSVKQGTVSSQPVPFSALGPTEKPGIEIGKVPPPIPGVGKQLPPSYGTYPSPTPLGPGSTSSLERRKEGSLPRPSAGLPSRQRPTLLPATGSTPQPGSSQQIQQRISVPPSPTYPPAGPPAFPAGDSKPELPLTVAIRPFLADKGSRPQSPRKGPQTVNSSSIYSMYLQQATPPKNYQPAAHSALNKSVKAVYGKPVLPSGSTSPSPLPFLHGSLSTGTPQPQPPSESTEKEPEQDGPAAPADGSTVESLPRPLSPTKLTPIVHSPLRYQSDADLEALRRKLANAPRPLKKRSSITEPEGPGGPNIQKLLYQRFNTLAGGMEGTPFYQPSPSQDFMGTLADVDNGNTNANGNLEELPPAQPTAPLPAEPAPSSDANDNELPSPEPEELICPQTTHQTAEPAEDNNNNVATVPTTEQIPSPVAEAPSPGEEQVPPAPLPPASHPPATSTNKRTNLKKPNSERTGHGLRVRFNPLALLLDASLEGEFDLVQRIIYEVEDPSKPNDEGITPLHNAVCAGHHHIVKFLLDFGVNVNAADSDGWTPLHCAASCNSVHLCKQLVESGAAIFASTISDIETAADKCEEMEEGYIQCSQFLYGVQEKLGVMNKGVAYALWDYEAQNSDELSFHEGDALTILRRKDESETEWWWARLGDREGYVPKNLLGLYPRIKPRQRTLA

SEQ ID NO: 849297 - protein, 1105 aa, Homo sapiens
AAGRSRCIWGRSSPRSSQMILTVFLSNNEQILTEVPITPETTCRDVVEFCKEPGEGSCHLAEVWRGNERPIPFDHMMYEHLQKWGPRREEVKFFLRHEDSPTENSEQGGRQTQEQRTQRNVINVPGEKRTENGVGNPRVELTLSELQDMAARQQQQIENQQQMLVAKEQRLHFLKQQERRQQQSISENEKLQKLKERVEAQENKLKKIRAMRGQVDYSKIMNGNLSAEIERFSAMFQEKKQEVQTAILRVDQLSQQLEDLKKGKLNGFQSYNGKLTGPAAVELKRLYQELQIRNQLNQEQNSKLQQQKELLNKRNMEVAMMDKRISELRERLYGKKIQLNRVNGTSSPQSPLSTSGRVAAVGPYIQVPSAGSFPVLGDPIKPQSLSIASNAAHGRSKSANDGNWPTLKQNSSSSVKPVQVAGADWKDPSVEGSVKQGTVSSQPVPFSALGPTEKPGIEIGKVPPPIPGVGKQLPPSYGTYPSPTPLGPGSTSSLERRKEGSLPRPSAGLPSRQRPTLLPATGSTPQPGSSQQIQQRISVPPSPTYPPAGPPAFPAGDSKPELPLTVAIRPFLADKGSRPQSPRKGPQTVNSSSIYSMYLQQATPPKNYQPAAHSALNKSVKAVYGKPVLPSGSTSPSPLPFLHGSLSTGTPQPQPPSESTEKEPEQDGPAAPADGSTVESLPRPLSPTKLTPIVHSPLRYQSDADLEALRRKLANAPRPLKKRSSITEPEGPGGPNIQKLLYQRFNTLAGGMEGTPFYQPSPSQDFMGTLADVDNGNTNANGNLEELPPAQPTAPLPAEPAPSSDANDNELPSPEPEELICPQTTHQTAEPAEDNNNNVATVPTTEQIPSPVAEAPSPGEEQVPPAPLPPASHPPATSTNKRTNLKKPNSERTGHGLRVRFNPLALLLDASLEGEFDLVQRIIYEVEDPSKPNDEGITPLHNAVCAGHHHIVKFLLDFGVNVNAADSDGWTPLHCAASCNSVHLCKQLVESGAAIFASTISDIETAADKCEEMEEGYIQCSQFLYGVQEKLGVMNKGVAYALWDYEAQNSDELSFHEGDALTILRRKDESETEWWWARLGDREGYVPKNLLGLYPRIKPRQRTLA

SEQ ID NO: 849298 - protein, 398 aa, Homo sapiens
MYLQQATPPKNYQPAAHSALNKSVKAVYGKPVLPSGSTSPSPLPFLHGSLSTGTPQPQPPSESTEKEPEQDGPAAPADGSTVESLPRPLSPTKLTPIVHSPLRYQSDADLEALRRKLANAPRPLKKRSSITEPEGPGGPNIQKLLYQRFNTLAGGMEGTPFYQPSPSQDFMGTLADVDNGNTNANGNLEELPPAQPTAPLPAEPAPSSDANDNELPSPEPEELICPQTTHQTAEPAEDNNNNVATVPTTEQIPSPVAEAPSPGEEQVPPAPLPPASHPPATSTNKRTNLKKPNSERTGHGLRVRFNPLALLLDASLEGEFDLVQRIIYEVEDPSKPNDEGITPLHNAVCAGHHHIVKFLLDFGVNVNAADSDGWGAGKAGCDEQRCGVCSVGLRGPEQ

SEQ ID NO: 849299 - protein, 509 aa, Homo sapiens [sequence omitted]

SEQ ID NO: 849300 - protein, 954 aa, Homo sapiens
MPMILTVFLSNNEQILTEVPITPETTCRDVVEFCKEPGEGSCHLAEVWRGNERPIPFDHMMYEHLQKWGPRREEVKFFLRHEDSPTENSEQGGRQTQEQRTQRNVINVPGEKRTENGVGNPRVELTLSELQDMAARQQQQIENQQQMLVAKEQRLHFLKQQERRQQQSISENEKLQKLKERVEAQENKLKKIRAMRGQVDYSKIMNGNLSAEIERFSAMFQEKKQEVQTAILRVDQLSQQLEDLKKGKLNGFQSYNGKLTGPAAVELKRLYQELQIRNQLNQEQNSKLQQQKELLNKRNMEVAMMDKRISELRERLYGKKIQLNRVNGTSSPQSPLSTSGRVAAVGPYIQVPSAGSFPVLGDPIKPQSLSIASNAAHGRSKSANDGNWPTLKQNSSSSVKPVQVAGADWKDPSVEGSVKQGTVSSQPVPFSALGPTEKPGIEIGKVPPPIPGVGKQLPPSYGTYPSPTPLGPGSTSSLERRKEGSLPRPSAGLPSRQRPTLLPATGSTPQPGSSQQIQQRISVPPSPTYPPAGPPAFPAGDSKPELPLTVAIRPFLADKGSRPQSPRKGPQTVNSSSIYSMYLQQATPPKNYQPAAHSALNKSVKAVYGKPVLPSGSTSPSPLPFLHGSLSTGTPQPQPPSESTEKEPEQDGPAAPADGSTVESLPRPLSPTKLTPIVHSPLRYQSDADLEALRRKLANAPRPLKKRSSITEPEGPGGPNIQKLLYQRFNTLAGGMEGTPFYQPSPSQDFMGTLADVDNGNTNANGNLEELPPAQPTAPLPAEPAPSSDANDNELPSPEPEELICPQTTHQTAEPAEDNNNNVATVPTTEQIPSPVAEAPSPGEEQVPPAPLPPASHPPATSTNKRTNLKKPNSERTGHGLRVRFNPLALLLDASLEGEFDLVQRIIYEVEDPSKPNDEGITPLHNAVCAGHHHIVKFLLDFGVNVNAADSDGW

SEQ ID NO: 849301 - protein, 274 aa, Homo sapiens
GLGTRLGGHVVLERQRVIIDELIKKLDMNLNEDISSLSTEELRQRVDAAVAQIVNPARVKEQLVEQLKTQIRDLEMFINFIQDEVGSPLQTGGGHCECKAGGKTGNGCSRTGSSRTPPGNSKTKAEDVKKVRETGLHLMRRALAVLQIFAVSQFGCATGQIPPTLWQRVQADRDYSPLLKRLEVSVDRVKQLALRQQPHDHVITSANLQDLSLGGKDELTMAVRKELTVAVRDLLAHGLYASSPGMSLVGLMCCAASLGQSMTGSLKTHEEGGM

SEQ ID NO: 849302 - protein, 613 aa, Homo sapiens
MAAVEAAAEPVTVVAAVGPKAKDEEEEEEEPLPPCEAVRWAPVGAVAEARPGATAFLEEATAEEPGAAPGSPPDSPGRTLRRLRAERRRLDSALLALSSHFAQVQFRLRQVVRGAPAEQQRLLRELEDFAFRGCPHVLGYEGPGDPASDEGDGLPGDRPRLRGEDQSEQEKQERLETQREKQKELILQLKTQLDDLETFAYQEGSYDSLPQSVVLERQRVIIDELIKKLDMNLNEDISSLSTEELRQRVDAAVAQIVNPARVKEQLVEQLKTQIRDLEMFINFIQDEVGSPLQTGGGHCECKAGGKTGNGCSRTGSSRTPPGNSKTKAEDVKKVRETGLHLMRRALAVLQIFAVSQFGCATGQIPPTLWQRVQADRDYSPLLKRLEVSVDRVKQLALRQQPHDHVITSANLQDLSLGGKDELTMAVRKELTVAVRDLLAHGLYASSPGMSLVMAPIACLLPAFSSAPEAMHPWELFVKYYHAKNGRAYVESPARKLSQSFALPVTGGTVVTPKQSLLTAIHMVLTEHDPFKRSADSELKALVCMALNEQRLVSWVNLICKSGSLIEPHYQPWSYMAHTGFESALNLLSRLSSLKFSLPVDLAVRQLKNIKDAF

SEQ ID NO: 849303 - protein, 383 aa, Homo sapiens
MNLNEDISSLSTEELRQRVDAAVAQIVNPARVKEQLVEQLKTQIRDLEMFINFIQDEVGSPLQTGGGHCECKAGGKTGNGCSRTGSSRTPPGNSKTKAEDVKKVRETGLHLMRRALAVLQIFAVSQFGCATGQIPPTLWQRVQADRDYSPLLKRLEVSVDRVKQLALRQQPHDHVITSANLQDLSLGGKDELTMAVRKELTVAVRDLLAHGLYASSPGMSLVMAPIACLLPAFSSAPEAMHPWELFVKYYHAKNGRAYVESPARKLSQSFALPVTGGTVVTPKQSLLTAIHMVLTEHDPFKRSADSELKALVCMALNEQRLVSWVNLICKSGSLIEPHYQPWSYMAHTGFESALNLLSRLSSLKFSLPVDLAVRQLKNIKDAF

SEQ ID NO: 849304 - protein, 410 aa, Homo sapiens
GLGTRLGGHVVLERQRVIIDELIKKLDMNLNEDISSLSTEELRQRVDAAVAQIVNPARVKEQLVEQLKTQIRDLEMFINFIQDEVGSPLQTGGGHCECKAGGKTGNGCSRTGSSRTPPGNSKTKAEDVKKVRETGLHLMRRALAVLQIFAVSQFGCATGQIPPTLWQRVQADRDYSPLLKRLEVSVDRVKQLALRQQPHDHVITSANLQDLSLGGKDELTMAVRKELTVAVRDLLAHGLYASSPGMSLVMAPIACLLPAFSSAPEAMHPWELFVKYYHAKNGRAYVESPARKLSQSFALPVTGGTVVTPKQSLLTAIHMVLTEHDPFKRSADSELKALVCMALNEQRLVSWVNLICKSGSLIEPHYQPWSYMAHTGFESALNLLSRLSSLKFSLPVDLAVRQLKNIKDAF

SEQ ID NO: 849305 - protein, 613 aa, Homo sapiens; identical to SEQ ID NO: 849302

SEQ ID NO: 849306 - protein, 110 aa, Homo sapiens
MNLNEDISSLSTEELRQRVDAAVAQIVNPARVKEQLVEQLKTQIRDLEMFINFIQDEVGSPLQTGGGHCECKAGGKTGNGCSRTGSSRTPPGNSKSKCSFQNRQISRDRK

SEQ ID NO: 849307 - protein, 336 aa, Homo sapiens
NSARYEAWDEVGSPLQTGGGHCECKAGGKTGNGCSRTGSSRTPPGNSKTKAEDVKKVRETGLHLMRRALAVLQIFAVSQFGCATGQIPPTLWQRVQADRDYSPLLKRLEVSVDRVKQLALRQQPHDHVITSANLQDLSLGGKDELTMAVRKELTVAVRDLLAHGLYASSPGMSLVMAPIACLLPAFSSAPEAMHPWELFVKYYHAKNGRAYVESPARKLSQSFALPVTGGTVVTPKQSLLTAIHMVLTEHDPFKRSADSELKALVCMALNEQRLVSWVNLICKSGSLIEPHYQPWSYMAHTGFESALNLLSRLSSLKFSLPVDLAVRQLKNIKDAF

SEQ ID NO: 849308 - protein, 454 aa, Homo sapiens
MASSEVARHLLFQSHMATKTTCMSSQGSDDEQIKRENIRSLTMSGHVGFESLPDQLVNRSIQQGFCFNILCVGETGIGKSTLIDTLFNTNFEDYESSHFCPNVKLKAQTYELQESNVQLKLTIVNTVGFGDQINKEESYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKNSNFL

SEQ ID NO: 849309 - protein, 431 aa, Homo sapiens
MASSEVARHLKRENIRSLTMSGHVGFESLPDQLVNRSIQQGFCFNILCVGETGIGKSTLIDTLFNTNFEDYESSHFCPNVKLKAQTYELQESNVQLKLTIVNTVGFGDQINKEESYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKNSNFL

SEQ ID NO: 849310 - protein, 261 aa, Homo sapiens
MKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKNSNFL

SEQ ID NO: 849311 - protein, 370 aa, Homo sapiens
HRRVEGRARCVQSGAGTPFSCLSLPSSWDYSSFSLTWQRKQLVCLHKDQMMNRYYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKNSNFL

SEQ ID NO: 849312 - protein, 450 aa, Homo sapiens
MASSEVARHLLFQSHMATKTTCMSSQGSDDEQIKRENIRSLTMSGHVGFESLPDQLVNRSIQQGFCFNILCVGETGIGKSTLIDTLFNTNFEDYESSHFCPNVKLKAQTYELQESNVQLKLTIVNTVGFGDQINKEESYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKK

SEQ ID NO: 849313 - protein, 488 aa, Homo sapiens
MASSEVARHLLFQSHMATKTTCMSSQGSDDEQIKRENIRSLTMSGHVGFESLPDQLVNRSIQQGFCFNILCVGETGIGKSTLIDTLFNTNFEDYESSHFCPNVKLKAQTYELQESNVQLKLTIVNTVGFGDQINKEESYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKKEPGCRFELLCIDVRACETNGGRKDAEKGREGHSARGQP

SEQ ID NO: 849314 - protein, 359 aa, Homo sapiens
MASSEVARHLLFQSHMATKTTCMSSQGSDDEQIKRENIRSLTMSGHVGFESLPDQLVNRSIQQGFCFNILCVGETGIGKSTLIDTLFNTNFEDYESSHFCPNVKLKAQTYELQESNVQLKLTIVNTVGFGDQINKEESYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSCLDSVEWRRHSLLTWP

SEQ ID NO: 849315 - protein, 454 aa, Homo sapiens; identical to SEQ ID NO: 849308

SEQ ID NO: 849316 - protein, 445 aa, Homo sapiens
MLFQSHMATKTTCMSSQGSDDEQIKRENIRSLTMSGHVGFESLPDQLVNRSIQQGFCFNILCVGETGIGKSTLIDTLFNTNFEDYESSHFCPNVKLKAQTYELQESNVQLKLTIVNTVGFGDQINKEESYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKNSNFL

SEQ ID NO: 849317 - protein, 359 aa, Homo sapiens
MASSEVARHLLFQSHMATKTTCMSSQGSDDEQIKRENIRSLTMSGHVGFESLPDQLVNRSIQQGFCFNILCVGETGIGKSTLIDTLFNTNFEDYESSHFCPNVKLKAQTYELQESNVQLKLTIVNTVGFGDQINKEESYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSYRPNLSTLRDFTKKRE

SEQ ID NO: 849318 - protein, 452 aa, Homo sapiens
LPASRGPQSLLRSSRLHSSRRLPGVPALLQPAPTLTLSPQASRVAPVRGSLGARKTLSAHHRASAPTPPPEASSSAPPLSLPRRGGSLASRPARCFCPPAFPPPSPGPAARGRADTAASPCPCPRPWPPPRWRGTCYQPIVDYIDAQFEAYLQEELKIKRSLFTYHDSRIHVCLYFISPTGHSLKTLDLLTMKNLDSKVNIIPVIAKADTVSKTELQKFKIKLMSELVSNGVQIYQFPTDDDTIAKVNAAMNGQLPFAVVGSMDEVKVGNKMVKARQYPWGVVQVENENHCDFVKLREMLICTNMEDLREQTHTRHYELYRRCKLEEMGFTDVGPENKPVSVQETYEAKRHEFHGERQRKEEEMKQMFVQRVKEKEAILKEAERELQAKFEHLKRLHQEERMKLEEKRRLLEEEIIAFSKKKATSEIFHSQSFLATGSNLRKDKDRKNSNFL

SEQ ID NO: 849319 - protein, 261 aa, Homo sapiens; identical to SEQ ID NO: 849310

SEQ ID NO: 849320 - protein, 360 aa, Homo sapiens
MYSFCENSTYMLCAFYRYIYCDEIDLAADTVLATLYAAKKYIVPHLARACVNFLETSLSAKNACVLLSQSCLFEEPDLTQRCWEVIDAQAELALKSEGFCDIDFQTLESILRRETLNAKEIVVFEAALNWAEVECQRQDLALSIENKRKVLGKALYLIRIPTMALDDFANGAAQSGVLTLNETNDIFLWYTAAKKPELQFVSKARKGLVPQRCHRFQSCAYRSNQWRYRGRCDSIQFAVDKRVFIAGFGLYGSSCGSAEYSAKIELKRQGVVLGQNLSKYFSDGSSNTFPVWFEYPVQIEPDTFYTASVILDGNELSYFGQEGMTEVQCGKVTVQFQCSSDSTNGTGVQGGQIPELIFYA

SEQ ID NO: 849321 - protein, 545 aa, Homo sapiens
SGRVPAEPAGRWISECPGRGLRSGHRARRRTAASPEARRSAGETVKNRSKKSSKKANTSSSSSNSSKLPPVCYEIITLKTKKKKMAADIFPRKKPANSSSTSVQQYHQQNLSNNNLIPAPNWQGLYPTIRERNAMMFNNDLMADVHFVVGPPGGTQRLPGHKYVLAVGSSVFHAMFYGELAEDKDEIRIPDVEPAAFLAMLKYIYCDEIDLAADTVLATLYAAKKYIVPHLARACVNFLETSLSAKNACVLLSQSCLFEEPDLTQRCWEVIDAQAELALKSEGFCDIDFQTLESILRRETLNAKEIVVFEAALNWAEVECQRQDLALSIENKRKVLGKALYLIRIPTMALDDFANGAAQSGVLTLNETNDIFLWYTAAKKPELQFVSKARKGLVPQRCHRFQSCAYRSNQWRYRGRCDSIQFAVDKRVFIAGFGLYGSSCGSAEYSAKIELKRQGVVLGQNLSKYFSDGSSNTFPVWFEYPVQIEPDTFYTASVILDGNELSYFGQEGMTEVQCGKVTVQFQCSSDSTNGTGVQGGQIPELIFYA

SEQ ID NO: 849322 - protein, 522 aa, Homo sapiens
MVDDKEKNMKCLTFFLMLPETVKNRSKKSSKKANTSSSSSNSSKLPPVCYEIITLKTKKKKMAADIFPRKKPANSSSTSVQQYHQQNLSNNNLIPAPNWQGLYPTIRERNAMMFNNDLMADVHFVVGPPGGTQRLPGHKYVLAVGSSVFHAMFYGELAEDKDEIRIPDVEPAAFLAMLKYIYCDEIDLAADTVLATLYAAKKYIVPHLARACVNFLETSLSAKNACVLLSQSCLFEEPDLTQRCWEVIDAQAELALKSEGFCDIDFQTLESILRRETLNAKEIVVFEAALNWAEVECQRQDLALSIENKRKVLGKALYLIRIPTMALDDFANGAAQSGVLTLNETNDIFLWYTAAKKPELQFVSKARKGLVPQRCHRFQSCAYRSNQWRYRGRCDSIQFAVDKRVFIAGFGLYGSSCGSAEYSAKIELKRQGVVLGQNLSKYFSDGSSNTFPVWFEYPVQIEPDTFYTASVILDGNELSYFGQEGMTEVQCGKVTVQFQCSSDSTNGTGVQGGQIPELIFYA

SEQ ID NO: 849323 - protein, 545 aa, Homo sapiens; identical to SEQ ID NO: 849321

SEQ ID NO: 849324 - protein, 545 aa, Homo sapiens; identical to SEQ ID NO: 849321

SEQ ID NO: 849325 - protein, 545 aa, Homo sapiens; identical to SEQ ID NO: 849321

SEQ ID NO: 849326 - protein, 545 aa, Homo sapiens; identical to SEQ ID NO: 849321

SEQ ID NO: 849327 - protein, 407 aa, Homo sapiens
MAPPLAPLPPRDPNGAGPEWREPGAVSFADVAVYFCREEWGCLRPAQRALYRDVMRETYGHLSALGIGGNKPALISWVEEEAELWGPAAQDPEVAKCQTQTDPDSRNKKKERQREGTGALEKPDPVAAGSPGLKSPQAPSAGPPYGWEQLSKAPHRGRPSLCAHPPVPRADQRHGCYVCGKSFAWRSTLVEHVYSHTGEKPFHCTDCGKGFGHASSLSKHRAIHRGERPHRCLECGRAFTQRSALTSHLRVHTGEKPYGCADCGRRFSQSSALYQHRRVHSGETPFPCPDCGRAFAYPSDLRRHVRTHTGEKPYPCPDCGRCFRQSSEMAVHRRTHSGEKPYPCPQCGRRFGQKSAVAKHQWVHRPGAGGHRGRVAGRLSVTLTPGHGDLDPPVGFQLYPEIFQECG

SEQ ID NO: 849328 - protein, 454 aa, Homo sapiens
MAPPLAPLPPRDPNGAGPEWREPGAVSFADVAVYFCREEWGCLRPAQRALYRDVMRETYGHLSALGESPTCSPEPCAPTGPAAPLGAAREVGGPGAGQVASPQRGVCVLLPKESEATSQLSSPGWRRRPNCGVRLPRIRRWRNVRHKRTQDSRNKKKERQREGTGALEKPDPVAAGSPGLKSPQAPSAGPPYGWEQLSKAPHRGRPSLCAHPPVPRADQRHGCYVCGKSFAWRSTLVEHVYSHTGEKPFHCTDCGKGFGHASSLSKHRAIHRGERPHRCLECGRAFTQRSALTSHLRVHTGEKPYGCADCGRRFSQSSALYQHRRVHSGETPFPCPDCGRAFAYPSDLRRHVRTHTGEKPYPCPDCGRCFRQSSEMAVHRRTHSGEKPYPCPQCGRRFGQKSAVAKHQWVHRPGAGGHRGRVAGRLSVTLTPGHGDLDPPVGFQLYPEIFQECG

SEQ ID NO: 849329 - protein, 454 aa, Homo sapiens; identical to SEQ ID NO: 849328

SEQ ID NO: 849330 - protein, 454 aa, Homo sapiens; identical to SEQ ID NO: 849328

SEQ ID NO: 849331 - protein, 454 aa, Homo sapiens; identical to SEQ ID NO: 849328

SEQ ID NO: 849332 - protein, 454 aa, Homo sapiens; identical to SEQ ID NO: 849328

SEQ ID NO: 849333 - protein, 379 aa, Homo sapiens
MAPPLAPLPPRDPNGAGPEWREPGAVSFADVAVYFCREEWGCLRPAQRALYRDVMRETYGHLSALGESPTCSPEPCAPTGPAAPLGAAREVGGPGAGQVASPQRGVCVLLPKESEATSQLSSPGWRRRPNCGVRLPRIRRWRNVRHKRTQDSRNKKKERQREGTGALEKPDPVAAGSPGLKSPQAPSAGPPYGWEQLSKAPHRGRPSLCAHPPVPRADQRHGCYVCGKSFAWRSTLVEHVYSHTGEKPFHCTDCGKGFGHASSLSKHRAIHRGERPHRCLECGRAFTQRSALTSPTPRTCGATCAPTPARSPTRARTAGAASARARRWQSTGAPTAARSPTPARSAAAALARSQPWPNTSGFIGPGPGATGAGSPGVCL

SEQ ID NO: 849334 - protein, 454 aa, Homo sapiens; identical to SEQ ID NO: 849328

SEQ ID NO: 849335 - protein, 369 aa, Homo sapiens
MAPPLAPLPPRDPNGAGPEWREPGAVSFADVAVYFCREEWGCLRPAQRALYRDVMRETYGHLSALDSRNKKKERQREGTGALEKPDPVAAGSPGLKSPQAPSAGPPYGWEQLSKAPHRGRPSLCAHPPVPRADQRHGCYVCGKSFAWRSTLVEHVYSHTGEKPFHCTDCGKGFGHASSLSKHRAIHRGERPHRCLECGRAFTQRSALTSHLRVHTGEKPYGCADCGRRFSQSSALYQHRRVHSGETPFPCPDCGRAFAYPSDLRRHVRTHTGEKPYPCPDCGRCFRQSSEMAVHRRTHSGEKPYPCPQCGRRFGQKSAVAKHQWVHRPGAGGHRGRVAGRLSVTLTPGHGDLDPPVGFQLYPEIFQECG

SEQ ID NO: 849336 - protein, 454 aa, Homo sapiens; identical to SEQ ID NO: 849328

SEQ ID NO: 849337 - protein, 263 aa, Homo sapiens
MEPPFTRLEGRMSRRAAPFGASQDGAGWVQLVKRNAAPQPLQTKPNSPARGWITGHPAAAFPPEEPRRLPRPEMPPVWLCLSPVPRQLGGSIPKQMHPAHDGTPGTPILRTLQSFKLELAGFCLYRHRLQSLRCCLAGKCRAGGAGPQLEAPRCSPPLHCRAQGGQEQPQQQQKPNWERNRGKNPHRLLGTYKEMPTSILLTWHLLTWHLLGCHKTDKSFHVRLDTCQGGVSKLGHRQHPRPGHWVEETVLGRSRREGPGLFP

SEQ ID NO: 849338 - protein, 153 aa, Homo sapiens
DAPVPGRAERWCLAQVPQHIRVRTLKTPQFPRLMATCPSDTAMLSHSPTIGSECAPQIHSEKLIPQSNSVERWNLMGAPPSQTNSCSCQDSLGMDSSLPSAMWTRGLPPLSPPGNAVFGRHLGSRDQASPDTKPAGTMTLDSQPPQLGKNSAP

SEQ ID NO: 849339 - protein, 139 aa, Homo sapiens
PALGARVRGKMAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFHDTSSPLMVTPPSAEAHWAVRVSERE

SEQ ID NO: 849340 - protein, 874 aa, Homo sapiens
PALGARVRGKMAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFHDTSSPLMVTPPSAEAHWAVRVEEKAKFDGIFESLLPINGLLSGDKVKPVLMNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHESRQEAHRSLEQYDQVLDGAHGASLTDLANLSEGVSLAERGSFGAMDDPFKNKALLFSNNTQELHPDPFQTEDPFKSDPFKGADPFKGDPFQNDPFAEQQTTSTDPFGGDPFKESDPFRGSATDDFFKKQTKNDPFTSDPFTKNPSLPSKLDPFESSDPFSSSSVSSKGSDPFGTLDPFGSGSFNSAEGFADFSQMSKPPPSGPFTSSLGGAGFSDDPFKSKQDTPALPPKKPAPPRPKPPSGKSTPVSQLGSADFPEAPDPFQPLGADSGDPFQSKKGFGDPFSGKDPFVPSSAAKPSKASASGFADFTSVS

SEQ ID NO: 849341 - protein, 764 aa, Homo sapiens
PALGARVRGKMAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFHDTSSPLMVTPPSAEAHWAVRVEEKAKFDGIFESLLPINGLLSGDKVKPVLMNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHESRQEAHRSLEQYDQVLDGAHGASLTDLANLSEGVSLAERGSFGAMDDPFKNKALLFSNNTQELHPDPFQTEDPFKSDPFKGADPFKGDPFQNDPFAEQQTTSTDPFGGDPFKESDPFRGSATDDFFKKQTKNDPFTSDPFTKNPSLPSKLDPFESSDPFSSSSVSSKGSDPFGTLDPFGSGSFNSAEGFADFSQMSKVKVHL

SEQ ID NO: 849342 - protein, 920 aa, Homo sapiens
PALGARVRGKMAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFHDTSSPLMVTPPSAEAHWAVRVEEKAKFDGIFESLLPINGLLSGDKVKPVLMNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHESRQEAHRSLEQYDQVLDGAHGASLTDLANLSEGVSLAERGSFGAMDDPFKNKALLFSNNTQELHPDPFQTEDPFKSDPFKGADPFKGDPFQNDPFAEQQTTSTDPFGGDPFKESDPFRGSATDDFFKKQTKNDPFTSDPFTKNPSLPSKLDPFESSDPFSSSSVSSKGSDPFGTLDPFGSGSFNSAEGFADFSQMSKPPPSGPFTSSLGGAGFSDDPFKSKQDTPALPPKKPAPPRPKPPSGKSTPVSQLGSADFPEAPDPFQPLGADSGDPFQSKKGFGDPFSGKDPFVPSSAAKPSKASASGFADFTSFGNEEQQLAWAKRESEKAEQERLARLRRQEQEDLELAIALSKADMPAA

SEQ ID NO: 849343 - protein, 896 aa, Homo sapiens
PALGARVRGKMAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFQNPPTYDLILCQPQRNVSLSSQHDTSSPLMVTPPSAEAHWAVRVEEKAKFDGIFESLLPINGLLSGDKVKPVLMNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHESRQEAHRSLEQYDQVLDGAHGASLTDLANLSEGVSLAERGSFGAMDDPFKNKALLFSNNTQELHPDPFQTEDPFKSDPFKGADPFKGDPFQNDPFAEQQTTSTDPFGGDPFKESDPFRGSATDDFFKKQTKNDPFTSDPFTKNPSLPSKLDPFESSDPFSSSSVSSKGSDPFGTLDPFGSGSFNSAEGFADFSQMSKPPPSGPFTSSLGGAGFSDDPFKSKQDTPALPPKKPAPPRPKPPSGKSTPVSQLGSADFPEAPDPFQPLGADSGDPFQSKKGFGDPFSGKDPFVPSSAAKPSKASASGFADFTSVS

SEQ ID NO: 849344 - protein, 807 aa, Homo sapiens
PALGARVRGKMAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFHDTSSPLMVTPPSAEAHWAVRVEEKAKFDGIFESLLPINGLLSGDKVKPVLMNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHESRQEAHRSLEQYDQVLDGAHGASLTDLANLSEGVSLAERGSFGAMDDPFKNKALLFSNNTQELHPDPFQTEDPFKSDPFKGADPFKGDPFQNDPFAEQQTTSTDPFGGDPFKESDPFRGSATDDFFKKQTKNDPFTSDPFTKNPSLPSKLDPFESSDPFSSSSVSSKGSDPFGTLDPFGSGSFNSAEGFADFSQMSKFGNEEQQLAWAKRESEKAEQERLARLRRQEQEDLELAIALSKADMPAA

SEQ ID NO: 849345 - protein, 611 aa, Homo sapiens
PALGARVRGKMAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFHDTSSPLMVTPPSAEAHWAVRVEEKAKFDGIFESLLPINGLLSGDKVKPVLMNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHESRQEAHRSLEQYDQVLDGAHGASLTDLANLSEGVSLAERGSFGAMVKVE

SEQ ID NO: 849346 - protein, 668 aa, Homo sapiens
PALGARVRGKMAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFHDTSSPLMVTPPSAEAHWAVRVEEKAKFDGIFESLLPINGLLSGDKVKPVLMNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHEGRSRLLVVVHLLLRALGPPGSYRMPTLRWKLSTCSSSVSSVRGTLGEAEPRRRQLGLSCGATCSRSFLGDRPRGGPGGSASSEMVPRSVRSVQLGRGSSRYSQAKY

SEQ ID NO: 849347 - protein, 173 aa, Homo sapiens
MVSSWTAQPDVTPPPSGPFTSSLGGAGFSDDPFKSKQDTPALPPKKPAPPRPKPPSGKSTPVSQLGSADFPEAPDPFQPLGADSGDPFQSKKGFGDPFSGKDPFVPSSAAKPSKASASGFADFTSFGNEEQQLAWAKRESEKAEQERLARLRRQEQEDLELAIALSKADMPAA

SEQ ID NO: 849348 - protein, 91 aa, Homo sapiens
AGPEHGHSGWFRRLPLDFWPRLPPVILDMLHFSHPHVNPCNSSLELQNDLDRETSSLQELEAQKQDAQDRLDEMDQQKAKLRDMLSDVRQK

SEQ ID NO: 849349 - protein, 447 aa, Homo sapiens
MNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHESRQEAHRSLEQYDQVLDGAHGASLTDLANLSEGVSLAERGSFGAMVKVE

SEQ ID NO: 849350 - protein, 764 aa, Homo sapiens; identical to SEQ ID NO: 849341

SEQ ID NO: 849351 - protein, 461 aa, Homo sapiens
PALGARVRGKMAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFHDTSSPLMVTPPSAEAHWAVRVEEKAKFDGIFESLLPINGLLSGDKVKPVLMNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQLQTSPPALPRISQTLPQWCMHSLYKMKFE

SEQ ID NO: 849352 - protein, 89 aa, Homo sapiens
RPPNLYGPFTSSTGLNRSGKSTPVSQLGSADFPEAPDPFQPLGADSGDPFQSKKGFGDPFSGKDPFVPSSAAKPSKASASGFADFTSVS

SEQ ID NO: 849353 - protein, 368 aa, Homo sapiens
MGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGEKFRRLAGEGGDPALPRPRLYPAAPAMPSPDVVYGALPPPGCDPSGLGEALPAQSRPSPFRPAAPKAGPPGLVHPLFSPSHLTSKTPPPLYLPTEGRRSDLPGGLAGPRGGLNTSRSLYSGLQNPCSTATPGPPLGSFPFLPGGPPEYGLGDPPPPPGLLQPPTLAPWQPSRGDGPPAVSSQPSGGRSLGEEGPPTRGASPPTPPVSIKSERLSPAPGGPGDFPKTFPYPLLLARSLAEPLRPGPALRRLPLADGWPR

SEQ ID NO: 849354 - protein, 368 aa, Homo sapiens; identical to SEQ ID NO: 849353

SEQ ID NO: 849355 - protein, 368 aa, Homo sapiens; identical to SEQ ID NO: 849353

SEQ ID NO: 849356 - protein, 368 aa, Homo sapiens; identical to SEQ ID NO: 849353

SEQ ID NO: 849357 - protein, 368 aa, Homo sapiens; identical to SEQ ID NO: 849353

SEQ ID NO: 849358 - protein, 119 aa, Homo sapiens
MEEPEMQLKGKKVTDKFTESVYVLANEPSVALYRLQEHVRRSLPELAQHKADMQRWEEQSQGAIYTVEYACSAVKNLVDSSVYFRSVEGLLKQAISIRDHMNASAQGHSPEEPPPPSSA

SEQ ID NO: 849359 - protein, 385 aa, Homo sapiens
MPVPRATDKDHSTQPGTMGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGEKFRRLAGEGGDPALPRPRLYPAAPAMPSPDVVYGALPPPGCDPSGLGEALPAQSRPSPFRPAAPKAGPPGLVHPLFSPSHLTSKTPPPLYLPTEGRRSDLPGGLAGPRGGLNTSRSLYSGLQNPCSTATPGPPLGSFPFLPGGPPEYGLGDPPPPPGLLQPPTLAPWQPSRGDGPPAVSSQPSGGRSLGEEGPPTRGASPPTPPVSIKSERLSPAPGGPGDFPKTFPYPLLLARSLAEPLRPGPALRRLPLADGWPR

SEQ ID NO: 849360 - protein, 433 aa, Homo sapiens
MPEDYPSACPFFLCHQQCMRAGSGRAYKIIIAHCNLELLGSQNPPVSGSHIARTTDKDHSTQPGTMGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGEKFRRLAGEGGDPALPRPRLYPAAPAMPSPDVVYGALPPPGCDPSGLGEALPAQSRPSPFRPAAPKAGPPGLVHPLFSPSHLTSKTPPPLYLPTEGRRSDLPGGLAGPRGGLNTSRSLYSGLQNPCSTATPGPPLGSFPFLPGGPPEYGLGDPPPPPGLLQPPTLAPWQPSRGDGPPAVSSQPSGGRSLGEEGPPTRGASPPTPPVSIKSERLSPAPGGPGDFPKTFPYPLLLARSLAEPLRPGPALRRLPLADGWPR

SEQ ID NO: 849361 - protein, 263 aa, Homo sapiens
MGQSWSRMKGLRSQERSFGGWQAKGVIRPCPDPGCILQLLLCPAQMWYTGPYRHQAVTPVGLGKHCPPRAAHLPSDQQPPKPGPQHLTSKTPPPLYLPTEGRRSDLPGGLAGPRGGLNTSRSLYSGLQNPCSTATPGPPLGSFPFLPGGPPEYGLGDPPPPPGLLQPPTLAPWQPSRGDGPPAVSSQPSGGRSLGEEGPPTRGASPPTPPVSIKSERLSPAPGGPGDFPKTFPYPLLLARSLAEPLRPGPALRRLPLADGWPR

SEQ ID NO: 849362 - protein, 445 aa, Homo sapiens
RGSVRPASQGPGRADKDHSTQPGTMGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGEKFRRLAGEGGDPALPRPRLYPAAPAMPSPDVVYGALPPPGCDPSGLGEALPAQSRPSPFRPAAPKAGPPGEHGTVGQGWVLRGCLGASWLWHCQAACITSKPQTSLVDMACLSSLSGVSSSPGLVHPLFSPSHLTSKTPPPLYLPTEGRRSDLPGGLAGPRGGLNTSRSLYSGLQNPCSTATPGPPLGSFPFLPGGPPEYGLGDPPPPPGLLQPPTLAPWQPSRGDGPPAVSSQPSGGRSLGEEGPPTRGASPPTPPVSIKSERLSPAPGGPGDFPKTFPYPLLLARSLAEPLRPGPALRRLPLADGWPR

SEQ ID NO: 849363 - protein, 349 aa, Homo sapiens
RGSVRPASQAQAEQQCMRAGSGRAYKIIIAHCNLELLGSQNPPVSGSHIARTTDKDHSTQPGTMGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGEKFRRLAGEGGDPALPRPRLYPAAPAMPSPDVVYGALPPPGCDPSGLGEALPAQSRPSPFRPAAPKAGPPEKPLQWPAEPLLHCNSRTPTGELPLPPRRPPSGGRSLGEEGPPTRGASPPTPPVSIKSERLSPAPGGPGDFPKTFPYPLLLARSLAEPLRPGPALRRLPLADGWPR

SEQ ID NO: 849364 - protein, 334 aa, Homo sapiens
MPVPRATDKDHSTQPGTMGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGEKFRRLAGEGGDPALPRPRLYPAAPAMPSPDVVYGALPPPGCDPSGLGEALPAQSRPSPFRPAAPKAGPPGLVHPLFSPSHLTSKTPPPLYLPTEGRRSDLPGGLAGPRGGLNTSSRSSTVAAEPLSCIPGPTVGSRSPGGPKMWGESTRGRSYGTQMRGSPEEMSPGGLPKGGQGEGHKAPRALIKRPTSAGQKKHCGQQTQTTRH

SEQ ID NO: 849365 - protein, 109 aa, Homo sapiens
MEEPEMQLKGKKVTDKFTESVYVLANEPSVALYRLQEHVRRSLPELAQHKADMQRWEEQSQGAIYTVEYACSAVKNLVDSSVYFRSVEGLLKQAISIRDHMNASAQGHR

SEQ ID NO: 849366 - protein, 119 aa, Homo sapiens; identical to SEQ ID NO: 849358

SEQ ID NO: 849367 - protein, 119 aa, Homo sapiens; identical to SEQ ID NO: 849358

SEQ ID NO: 849368 - protein, 119 aa, Homo sapiens; identical to SEQ ID NO: 849358

SEQ ID NO: 849369 - protein, 126 aa, Homo sapiens
AGRLELKGAAYLGRPVPQQVTDKFTESVYVLANEPSVALYRLQEHVRRSLPELAQHKADMQRWEEQSQGAIYTVEYACSAVKNLVDSSVYFRSVEGLLKQAISIRDHMNASAQGHSPEEPPPPSSA

SEQ ID NO: 849370 - protein, 109 aa, Homo sapiens; identical to SEQ ID NO: 849365

SEQ ID NO: 849371 - protein, 365 aa, Homo sapiens
MGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGEKFRRLAGEGGDPALPRPRLYPAAPAMPSPDVVYGALPPPGCDPSGLGEALPAQSRPSPFRPAAPKAGPPGLVHPLFSPSHLTSKTPPPLYLPTEGRRSDLPGGLAGPRGGLNTSRSLYSGLQNPCSTATPGPPLGSFPFLPGGPPVGAEAWARRVPQPAAPPRRPPQSASSLSASLRPPGAPATFLRPSPIPCSSPGPWQSLCGLGPPCAGCPWPTAGPGRRSPGGTSPERSPGTARARGDPTSLQASSEKTQQ

SEQ ID NO: 849372 - protein, 368 aa, Homo sapiens; identical to SEQ ID NO: 849353

SEQ ID NO: 849373 - protein, 392 aa, Homo sapiens
RGSVRPASQGPGRADKDHSTQPGTMGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGEKFRRLAGEGGDPALPRPRLYPAAPAMPSPDVVYGALPPPGCDPSGLGEALPAQSRPSPFRPAAPKAGPPGLVHPLFSPSHLTSKTPPPLYLPTEGRRSDLPGGLAGPRGGLNTSRSLYSGLQNPCSTATPGPPLGSFPFLPGGPPEYGLGDPPPPPGLLQPPTLAPWQPSRGDGPPAVSSQPSGGRSLGEEGPPTRGASPPTPPVSIKSERLSPAPGGPGDFPKTFPYPLLLARSLAEPLRPGPALRRLPLADGWPR

SEQ ID NO: 849374 - protein, 365 aa, Homo sapiens; identical to SEQ ID NO: 849371

SEQ ID NO: 849375 - protein, 286 aa, Homo sapiens
MGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGEKFRRLAGEGGDPALPRPRLYPAAPAMPSPDVVYGALPPPGCDPSGLGEALPAQSRPSPFRPAAPKAGPPEKPLQWPAEPLLHCNSRTPTGELPLPPRRPPSGGRSLGEEGPPTRGASPPTPPVSIKSERLSPAPGGPGDFPKTFPYPLLLARSLAEPLRPGPALRRLPLADGWPR

SEQ ID NO: 849376 - protein, 109 aa, Homo sapiens; identical to SEQ ID NO: 849365

SEQ ID NO: 849377 - protein, 230 aa, Homo sapiens
MGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGENDNEQAGSAEPRVNRAIAHPNTTGTDNMQNTLTTAQGPDCGKRAPNPPTTAEDHKRAQRRKALAQTQTHDPSRHQLPEPTPDTTTHAQGPQQGDRKDKHRQTNEHHKTNPNNTQQQQNS

SEQ ID NO: 849378 - protein, 109 aa, Homo sapiens; identical to SEQ ID NO: 849365

SEQ ID NO: 849379 - protein, 109 aa, Homo sapiens; identical to SEQ ID NO: 849365

SEQ ID NO: 849380 - protein, 168 aa, Homo sapiens
MPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIGWVPTENPVLTGSRNPLVGYLCSRDSGVWLRLTGAGSQGKRQRTGGKAHLKGKGEPGPQGG

SEQ ID NO: 849381 - protein, 279 aa, Homo sapiens
GASRGSQCGWGLGGEREAGPALARGGQNIARCQTGRTQRAGLRGSLLPPGAEHERESWRALPHRVLRCERGLVSVCCLQREKSSFQESIYRRGARRWRKLYRANGHLFQAKRFNRRAYCGQCSERIWGLARQGYRCINCKLLVHKRCHGLVPLTCRKHMDSVMPSQEPPVDDKNEDFDLIRVIGRGSYAKVLLVRLKKNDQIYAMKSGEEKSWCMMTRILTGYRQRSTCLSRHPATPSWSDYTPASRRQVGVFLVIEYVNGGDLMSENPVCAAPTSIWV

SEQ ID NO: 849382 - protein, 605 aa, Homo sapiens
PCQNLRLVYEDWVCASRTGPKMEGSGGRVRLKAHYGGDIFITSVDAATTFEELCEEVRDMCRLHQQHPLTLKWVDSEGDPCTVSSQMELEEAFRLARQCRDEGLIIHVFPSTPEQPGLPCPGEDKSIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 849383 - protein, 405 aa, Homo sapiens
MPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 849384 - protein, 405 aa, Homo sapiens; identical to SEQ ID NO: 849383

SEQ ID NO: 849385 - protein, 574 aa, Homo sapiens
KKKKKRTSLGAKTGRTQRAGLRGSLLPPGAEHERESWRALPHRVLRCERGLVSVCCLQREKSSFQESIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLVFHTKNTSNMMNEGGILCPHNPAVRTPQLEKKQALPPFQPQITDDYGLDNFDTQFTSEPVQLTPDDEDAIKRIDQSEFEGFEYINPLLLSTEESV

SEQ ID NO: 849386 - protein, 378 aa, Homo sapiens
MPVRPEHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 849387 - protein, 348 aa, Homo sapiens
MQILLWQPNTLILLPAPTPNTDISVFGKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 849388 - protein, 241 aa, Homo sapiens
PLSVAQSGRRPHRYFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 849389 - protein, 518 aa, Homo sapiens
KKKKKRTSLGAKTGRTQRAGLRGSLLPPGAEHERESWRALPHRVLRCERGLVSVCCLQREKSSFQESIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDE

SEQ ID NO: 849390 - protein, 546 aa, Homo sapiens
KKKKKRTSLGAKTGRTQRAGLRGSLLPPGAEHERESWRALPHRVLRCERGLVSVCCLQREKSSFQESIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 849391 - protein, 546 aa, Homo sapiens; identical to SEQ ID NO: 849390

SEQ ID NO: 849392 - protein, 546 aa, Homo sapiens; identical to SEQ ID NO: 849390

SEQ ID NO: 849393 - protein, 496 aa, Homo sapiens
KKKKKRTSLGAKTGRTQRAGLRGSLLPPGAEHERESWRALPHRVLRCERGLVSVCCLQREKSSFQESIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLVKHHRAYLHPHPHPNPK

SEQ ID NO: 849394 - protein, 462 aa, Homo sapiens
KKKKKRTSLGAKTGRTQRAGLRGSLLPPGAEHERESWRALPHRVLRCERGLVSVCCLQREKSSFQESIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKKAWALVTQRAFSARNHARGFLAEGKAGFELWSSQVDLVYVLLLCAGVHFSCNMVVNRPSTNTRDRTEAWQPSERSSGCEGAPILNFRQTMKIDFSTDPLILSRKCHHRK

SEQ ID NO: 849395 - protein, 405 aa, Homo sapiens
KKKKKRTSLGAKTGRTQRAGLRGSLLPPGAEHERESWRALPHRVLRCERGLVSVCCLQREKSSFQESIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKASFVLEELAAVPASRRIRGDPAEGAVMRFPRCTFSTETELDALTCSARKVSV

SEQ ID NO: 849396 - protein, 379 aa, Homo sapiens
KKKKKRTSLGAKTGRTQRAGLRGSLLPPGAEHERESWRALPHRVLRCERGLVSVCCLQREKSSFQESIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLPAQAPWRRFWIPIPSPSDNLVLRSSRVRLFNARPFPSRGDRW

SEQ ID NO: 849397 - protein, 219 aa, Homo sapiens
MPSRTGPKMEGSGGRVRLKAHYGGDIFITSVDAATTFEELCEEVRDMCRLHQQHPLTLKWVDSEGDPCTVSSQMELEEAFRLARQCRDEGLIIHVFPSTPEQPGLPCPGEDKSIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYFPLRS

SEQ ID NO: 849398 - protein, 163 aa, Homo sapiens
MPSQEPPVDDKNEDADLPSEETDGIAYISSSRKHDSIKDDSEDLKPVIDGMDGIKISQGLGLQDFDLIRVIGRGSYAKVLLVRLKKNDQIYAMKSGEEKSWCMMTRILTGYRQRSTCLSRHPATPSWSDYTPASVGSPVEESWDIEIVNGRDHEFRCKGEEVH

SEQ ID NO: 849399 - protein, 163 aa, Homo sapiens; identical to SEQ ID NO: 849398

SEQ ID NO: 849400 - protein, 167 aa, Homo sapiens
MDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKSGEEKSWCMMTRILTGYRQRSTCLSRHPATPSWSDYTPASVGSPVEVSWDIEIVNGRDHEFRCKGEEVH

SEQ ID NO: 849401 - protein, 144 aa, Homo sapiens
PCQYFRLVYEDWVCASRTGPKMEGSGGRVRLKAHYGGDIFITSVDAATTFEELCEEVRDMCRLHQQHPLTLKWVDSEGDPCTVSSQMELEEAFRLARQCRDEGLIIHVFPSTPEQPGLPCPGEDRRVKWEESGPTECVPGPGGV

SEQ ID NO: 849402 - protein, 592 aa, Homo sapiens
MPSRTGPKMEGSGGRVRLKAHYGGDIFITSVDAATTFEELCEEVRDMCRLHQQHPLTLKWVDSEGDPCTVSSQMELEEAFRLARQCRDEGLIIHVFPSTPEQPGLPCPGEDKSIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 849403 - protein, 107 aa, Homo sapiens
RRDVLEPFPLCNQASLSTPKPRIGTSGSLYPLQLVELSPGPLLRGFGLVPEFGTTDDYGLDNFDTQFTSEPVQLTPDDEDAIKRIDQSEFEGFEYINPLLLSTEESV

SEQ ID NO: 849404 - protein, 256 aa, Homo sapiens
MPSRTGPKMEGSGGRVRLKAHYGGDIFITSVDAATTFEELCEEVRDMCRLHQQHPLTLKWVDSEGDPCTVSSQMELEEAFRLARQCRDEGLIIHVFPSTPEQPGLPCPGEDKSIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVREDGGSKLGVGGELEKMGRTTS

SEQ ID NO: 849405 - protein, 295 aa, Homo sapiens
LAGLLPAWTQDPHPPARTLDSPPARPSVLVWTAPTSWLHPCFLPFDLQPQDVQEGESIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLNERMTKIYAMKSGEEKSWCMMTRILTGYRQRSTCLSRHPATPSWSDYTPASVGSPVEESWDIEIVNGRDHEFRCKGEEVH

SEQ ID NO: 849406 - protein, 252 aa, Homo sapiens
GASRGSQCGWGLGGEREAGPALARGGQNIARCQTGRTQRAGLRGSLLPPGAEHERESWRALPHRVLRCERGLVSVCCLQREKSSFQESIYRRGARRWRKLYRANGHLFQAKRFNRRAYCGQCSERIWGLARQGYRCINCKLLVHKRCHGLVPLTCRKHMVSGRAGEARGARAGSGRGSQPIVQADLGDPGFFKRGRGAVLALGCSVRLRRQSWIGPIFLSPHKPPAHSAHWGMRLRQQAQVGRGTLCSVGRR

SEQ ID NO: 849407 - protein, 131 aa, Homo sapiens
MLDTANNITPEILRNEELRFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLVKHHRAYLHPHPHPNP

SEQ ID NO: 849408 - protein, 546 aa, Homo sapiens; identical to SEQ ID NO: 849390

SEQ ID NO: 849409 - protein, 554 aa, Homo sapiens
KKKKKRTSLGAKTGRTQRAGLRGSLLPPGAEHERESWRALPHRVLRCERGLVSVCCLQREKSSFQESIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLRRLSPCRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 849410 - protein, 405 aa, Homo sapiens; identical to SEQ ID NO: 849383

SEQ ID NO: 849411 - protein, 355 aa, Homo sapiens
MDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 849412 - protein, 285 aa, Homo sapiens
HASRTRGGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 849413 - protein, 546 aa, Homo sapiens; identical to SEQ ID NO: 849390

SEQ ID NO: 849414 - protein, 546 aa, Homo sapiens; identical to SEQ ID NO: 849390

SEQ ID NO: 849415 - protein, 488 aa, Homo sapiens
KKKKKRTSLGAKTGRTQRAGLRGSLLPPGAEHERESWRALPHRVLRCERGLVSVCCLQREKSSFQESIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLVFHTKNTSN

SEQ ID NO: 849416 - protein, 452 aa, Homo sapiens
KKKKKRTSLGAKTGRTQRAGLRGSLLPPGAEHERESWRALPHRVLRCERGLVSVCCLQREKSSFQESIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKASFVLEELAAVPASRRIRGDPAEGAVMRFPRCTNLSTAGEPEDGGSCTVPTATSSKPSALTGERTAVSAARGYGASRGKATGASTANCWSISAATASSR

SEQ ID NO: 849417 - protein, 384 aa, Homo sapiens
KKKKKRTSLGAKTGRTQRAGLRGSLLPPGAEHERESWRALPHRVLRCERGLVSVCCLQREKSSFQESIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTHARGTNPIHVGSTLMT

SEQ ID NO: 849418 - protein, 163 aa, Homo sapiens
MPSQEPPVDDKNEDADLPSEETDGIAYISSSRKHDSIKDDSEDLKPVIDGMDGIKISQGLGLQDFDLIRVIGRGSYAKVLLVRLKKNDQIYAMKSGEEKSWCMMTRILTGYRQRSTCLSRHPATPSWSDYTPASVGSPVEVSWDIEIVNGRDHEFRCKGEEVH

SEQ ID NO: 849419 - protein, 349 aa, Homo sapiens
MAGAPWGLQLLDSAVLWVWMLLPVRQHVTCAPKDGMWMLAGLLSCLNGALRGVDIFITSVDAATTFEELCEEVRDMCRLHQQHPLTLKWVDSEVFPSTPEQPGLPCPGEDKSIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKSGEEKSWCMMTRILTGYRQRSTCLSRHPATPSWSDYTPASVGSPVEESWDIEIVNGRDHEFRCKGEEVH

SEQ ID NO: 849420 - protein, 325 aa, Homo sapiens
GASRGSQCGWGLGGEREAGPALARGGQNIARCQTGRTQRAGLRGSLLPPGAEHERESWRALPHRVLRCERGLVSVCCLQREKSSFQESIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKSGEEKSWCMMTRILTGYRQRSTCLSRHPATPSWSDYTPASVGSPVEESWDIEIVNGRDHEFRCKGEEVH

SEQ ID NO: 849421 - protein, 163 aa, Homo sapiens; identical to SEQ ID NO: 849418

SEQ ID NO: 849422 - protein, 104 aa, Homo sapiens
AGCALSSWVEPHGGSPDPLRAEGHRGRKCGRPWGSAPLVEPRPGAQVGGVWRGHRLHDPSLASGLLGVASVAGGAFGVTRPLSNPKPHPGRAGWAEPPAAVRPL

SEQ ID NO: 849423 - protein, 351 aa, Homo sapiens
MQRALPGARQHLGAILASASVVVKALCAAVLFLYLLSFAVDTGCLAVTPGYLFPPNFWIWTLATHGLMEQHVWDVAISLTTVVVAGRLLEPLWGALELLIFFSVVNVSVGLLGAFAYLLTYMASFNLVYLFTVRIHGALGFLGGVLVALKQTMGDCVVLRVPQVRVSVMPMLLLALLLLLRLATLLQSPALASYGFGLLSSWVYLRFYQRHSRGRGDMADHFAFATFFPEILQPVVGLLANLVHSLLVKVKICQKTVKRYDVGAPSSITISLPGTDPQDAERRRQLALKALNERLKRVEDQSIWPSMDDDEEESGAKVDSPLPSDKAPTPPGKGAAPESSLITFEAAPPTL

SEQ ID NO: 849424 - protein, 351 aa, Homo sapiens; identical to SEQ ID NO: 849423

SEQ ID NO: 849425 - protein, 351 aa, Homo sapiens; identical to SEQ ID NO: 849423

SEQ ID NO: 849426 - protein, 351 aa, Homo sapiens; identical to SEQ ID NO: 849423

SEQ ID NO: 849427 - protein, 42 aa, Homo sapiens
MQRALPGARQHLGAILASASVVVKALCAAVLFLYLHDNTYKK

SEQ ID NO: 849428 - protein, 351 aa, Homo sapiens; identical to SEQ ID NO: 849423

SEQ ID NO: 849429 - protein, 134 aa, Homo sapiens [sequence omitted]

SEQ ID NO: 849430 - protein, 151 aa, Homo sapiens
RFPADVVEENESGRGQDWRSCRFRRGAQNAAAASLERGPWGRNPRRARWQHTLGPPLPAASPEDGQQRNKKMDSLAAGELNASHQPWVPEFVAYWRKTHQAYATLCPLAKEAQLRPRSVPAQQSYRRPEAPSCSLLLYRRHAAKQMCRDTT

SEQ ID NO: 849431 - protein, 1173 aa, Homo sapiens
MISSLGVSKAVLNNVIFCHQEDSNWPLSEGKALKQKFDEIFSATRYIKALETLRQVRQTQGQKVKEYQMELKYLKQYKEKACEIRDQITSKEAQLTSSKEIVKSYENELDPLKNRLKEIEHNLSKIMKLDNEIKALDSRKKQMEKDNSELEEKMEKVFQGTDEQLNDLYHNHQRTVREKERKLVDCHRELEKLNKESRLLNQEKSELLVEQGRLQLQADRHQEHIRARDSLIQSLATQLELDGFERGPFSERQIKNFHKLVRERQEGEAKTANQLMNDFAEKETLKQKQIDEIRDKKTGLGRIIELKSEILSKKQNELKNVKYELQQLEGSSDRILELDQELIKAERELSKAEKNSNVETLKMEVISLQNEKADLDRTLRKLDQEMEQLNHHTTTRTQMEMLTKDKADKDEQIRKIKSRHSDELTSLLGYFPNKKQLEDWLHSKSKEINQTRDRLAKLNKELASSEQNKNHINNELKRKEEQLSSYEDKLFDVCGSQDFESDLDRLKEEIEKSSKQRAMLAGATAVYSQFITQLTDENQSCCPVCQRVFQTEAELQEVISDLQSKLRLAPDKLKSTESELKKKEKRRDEMLGLVPMRQSIIDLKEKEIPELRNKLQNVNRDIQRLKNDIEEQETLLGTIMPEEESAKVCLTDVTIMERFQMELKDVERKIAQQAAKLQGIDLDRTVQQVNQEKQEKQHKLDTVSSKIELNRKLIQDQQEQIQHLKSTTNELKSEKLQISTNLQRRQQLEEQTVELSTEVQSLYREIKDAKEQVSPLETTLEKFQQEKEELINKKNTSNKIAQDKLNDIKEKVKNIHGYMKDIENYIQDGKDDYKKQKETELNKVIAQLSECEKHKEKINEDMRLMRQDIDTQKIQERWLQDNLTLRKRNEELKEVEEERKQHLKEMGQMQVLQMKSEHQKLEENIDNIKRNHNLALGRQKGYEEEIIHFKKELREPQFRDAEEKYREMMIVMRTTELVNKDLDIYYKTLDQAIMKFHSMKMEEINKIIRDLWRSTYRGQDIEYIEIRSDADENVSASDKRRNYNYRVVMLKGDTALDMRGRCSAGQKVLASLIIRLALAETFCLNCGIIALDEPTTNLDRENIESLAHALVEIIKSRSQQRNFQLLVITHDEDFVELLGRSEYVEKFYRIKKNIDQCSEIVKCSVSSLGFNVH

SEQ ID NO: 849432 - protein, 108 aa, Homo sapiens
RFPADVVEENESGRGQDWRSCRFRRGAQNAAAASLERGPWGRNPRRARWQHTLGPPLPAASPEDGQQRNKKMDSLAAGELNASHQPWVPEFVAYWRKTHQALNSTVNG

SEQ ID NO: 849433 - protein, 115 aa, Homo sapiens
RFPADVVEENESGRGQDWRSCRFRRGAQNAAAASLERGPWGRNPRRARWQHTLGPPLPAASPEDGQQRNKKMDSLAAGELNASHQPWVPEFVAYWRKTHQGKTTIRPHLVWDCPT

SEQ ID NO: 849434 - protein, 1312 aa, Homo sapiens
MSRIEKMSILGVRSFGIEDKDKQIITFFSPLTILVGPNGAGKTTIIECLKYICTGDFPPGTKGNTFVHDPKVAQETDVRAQIRLQFRDVNGELIAVQRSMVCTQKSKKTEFKTLEGVITRTKHGEKVSLSSKCAEIDREMISSLGVSKAVLNNVIFCHQEDSNWPLSEGKALKQKFDEIFSATRYIKALETLRQVRQTQGQKVKEYQMELKYLKQYKEKACEIRDQITSKEAQLTSSKEIVKSYENELDPLKNRLKEIEHNLSKIMKLDNEIKALDSRKKQMEKDNSELEEKMEKVFQGTDEQLNDLYHNHQRTVREKERKLVDCHRELEKLNKESRLLNQEKSELLVEQGRLQLQADRHQEHIRARDSLIQSLATQLELDGFERGPFSERQIKNFHKLVRERQEGEAKTANQLMNDFAEKETLKQKQIDEIRDKKTGLGRIIELKSEILSKKQNELKNVKYELQQLEGSSDRILELDQELIKAERELSKAEKNSNVETLKMEVISLQNEKADLDRTLRKLDQEMEQLNHHTTTRTQMEMLTKDKADKDEQIRKIKSRHSDELTSLLGYFPNKKQLEDWLHSKSKEINQTRDRLAKLNKELASSEQNKNHINNELKRKEEQLSSYEDKLFDVCGSQDFESDLDRLKEEIEKSSKQRAMLAGATAVYSQFITQLTDENQSCCPVCQRVFQTEAELQEVISDLQSKLRLAPDKLKSTESELKKKEKRRDEMLGLVPMRQSIIDLKEKEIPELRNKLQNVNRDIQRLKNDIEEQETLLGTIMPEEESAKVCLTDVTIMERFQMELKDVERKIAQQAAKLQGIDLDRTVQQVNQEKQEKQHKLDTVSSKIELNRKLIQDQQEQIQHLKSTTNELKSEKLQISTNLQRRQQLEEQTVELSTEVQSLYREIKDAKEQVSPLETTLEKFQQEKEELINKKNTSNKIAQDKLNDIKEKVKNIHGYMKDIENYIQDGKDDYKKQKETELNKVIAQLSECEKHKEKINEDMRLMRQDIDTQKIQERWLQDNLTLRKRNEELKEVEEERKQHLKEMGQMQVLQMKSEHQKLEENIDNIKRNHNLALGRQKGYEEEIIHFKKELREPQFRDAEEKYREMMIVMRTTELVNKDLDIYYKTLDQAIMKFHSMKMEEINKIIRDLWRSTYRGQDIEYIEIRSDADENVSASDKRRNYNYRVVMLKGDTALDMRGRCSAGQKVLASLIIRLALAETFCLNCGIIALDEPTTNLDRENIESLAHALVEIIKSRSQQRNFQLLVITHDEDFVELLGRSEYVEKFYRIKKNIDQCSEIVKCSVSSLGFNVH

SEQ ID NO: 849435 - protein, 1105 aa, Homo sapiens [sequence omitted]

SEQ ID NO: 849436 - protein, 1312 aa, Homo sapiens; identical to SEQ ID NO: 849434

SEQ ID NO: 849437 - protein, 724 aa, Homo sapiens
MKIHICSYFSKELASSEQNKNHINNELKRKEEQLSSYEDKLFDVCGSQDFESDLDRLKEEIEKSSKQRAMLAGATAVYSQFITQLTDENQSCCPVCQRVFQTEAELQEVISDLQSKLRLAPDKLKSTESELKKKEKRRDEMLGLVPMRQSIIDLKEKEIPELRNKLQNVNRDIQRLKNDIEEQETLLGTIMPEEESAKVCLTDVTIMERFQMELKDVERKIAQQAAKLQGIDLDRTVQQVNQEKQEKQHKLDTVSSKIELNRKLIQDQQEQIQHLKSTTNELKSEKLQISTNLQRRQQLEEQTVELSTEVQSLYREIKDAKEQVSPLETTLEKFQQEKEELINKKNTSNKIAQDKLNDIKEKVKNIHGYMKDIENYIQDGKDDYKKQKETELNKVIAQLSECEKHKEKINEDMRLMRQDIDTQKIQERWLQDNLTLRKRNEELKEVEEERKQHLKEMGQMQVLQMKSEHQKLEENIDNIKRNHNLALGRQKGYEEEIIHFKKELREPQFRDAEEKYREMMIVMRTTELVNKDLDIYYKTLDQAIMKFHSMKMEEINKIIRDLWRSTYRGQDIEYIEIRSDADENVSASDKRRNYNYRVVMLKGDTALDMRGRCSAGQKVLASLIIRLALAETFCLNCGIIALDEPTTNLDRENIESLAHALVEIIKSRSQQRNFQLLVITHDEDFVELLGRSEYVEKFYRIKKNIDQCSEIVKCSVSSLGFNVH

SEQ ID NO: 849438 - protein, 312 aa, Homo sapiens [sequence omitted]

SEQ ID NO: 849439 - protein, 1295 aa, Homo sapiens
MSRIEKMSILGVRSFGIEDKDKQIITFFSPLTILVGPNGAGKTTIIECLKYICTGDFPPGTKGNTFVHDPKVAQETDVRAQIRLQFRDVNGELIAVQRSMVCTQKSKKTEFKTLEGVITRTKHGEKVSLSSKCAEIDREMISSLGVSKAVLNNVIFCHQEDSNWPLSEGKALKQKFDEIFSATRYIKALETLRQVRQTQGQKVKEYQMELKYLKQYKEKACEIRDQITSKEAQLTSSKEIVKSYENELDPLKNRLKEIEHNLSKIMKLDNEIKALDSRKKQMEKDNSELEEKMEKVFQGTDEQLNDLYHNHQRTVREKERKLVDCHRELEKLNKESRLLNQEKSELLVEQGRLQLQADRHQEHIRARDSLIQSLATQLELDGFERGPFSERQIKNFHKLVRERQEGEAKTANQLMNDFAEKETLKQKQIDEIRDKKTGLGRIIELKSEILSKKQNELKNVKYELQQLEGSSDRILELDQELIKAERELSKAEKNSNVETLKMEVISLQNEKADLDRTLRKLDQEMEQLNHHTTTRTQMEMLTKDKADKDEQIRKIKSRHSDELTSLLGYFPNKKQLEDWLHSKSKEINQTRDRLAKLNKELASSEQNKNHINNELKRKEEQLSSYEDKLFDVCGSQDFESDLDRLKEEIEKSSKQRAMLAGATAVYSQFITQLTDENQSCCPVCQRVFQTEAELQEVISDLQSKLRLAPDKLKSTESELKKKEKRRDEMLGLVPMRQSIIDLKEKEIPELRNKLQNVNRDIQRLKNDIEEQETLLGTIMPEEESAKVCLTDVTIMERFQMELKDVERKIAQQAAKLQGIDLDRTVQQVNQEKQEKQHKLDTVSSKIELNRKLIQDQQEQIQHLKSTTNELKSEKLQISTNLQRRQQLEEQTVELSTEVQSLYREIKDAKEQVSPLETTLEKFQQEKEELINKKNTSNKIAQDKLNDIKEKVKNIHGYMKDIENYIQDGKDDYKKQKETELNKVIAQLSECEKHKEKINEDMRLMRQDIDTQKIQERWLQDNLTLRKRNEELKEVEEERKQHLKEMGQMQVLQMKSEHQKLEENIDNIKRNHNLALGRQKGYEEEIIHFKKELREPQFRDAEEKYREMMIVMRTTELVNKDLDIYYKTLDQAIMKFHSMKMEEINKIIRDLWRSTYRGQDIEYIEIRSDADENVSASDKRRNYNYRVVMLKGDTALDMRGRCSAGQKVLASLIIRLALAETFCLNCGIIALDEPTTNLDRENIESLAHALVEIIKSRSQQRNFQLLVITHDEDFVELLGRSEYVEKFYRIKKNIDQ

SEQ ID NO: 849440 - protein, 1312 aa, Homo sapiens; identical to SEQ ID NO: 849434

SEQ ID NO: 849441 - protein, 1318 aa, Homo sapiens
MLIFSVRDMFAKMSILGVRSFGIEDKDKQIITFFSPLTILVGPNGAGKTTIIECLKYICTGDFPPGTKGNTFVHDPKVAQETDVRAQIRLQFRDVNGELIAVQRSMVCTQKSKKTEFKTLEGVITRTKHGEKVSLSSKCAEIDREMISSLGVSKAVLNNVIFCHQEDSNWPLSEGKALKQKFDEIFSATRYIKALETLRQVRQTQGQKVKEYQMELKYLKQYKEKACEIRDQITSKEAQLTSSKEIVKSYENELDPLKNRLKEIEHNLSKIMKLDNEIKALDSRKKQMEKDNSELEEKMEKVFQGTDEQLNDLYHNHQRTVREKERKLVDCHRELEKLNKESRLLNQEKSELLVEQGRLQLQADRHQEHIRARDSLIQSLATQLELDGFERGPFSERQIKNFHKLVRERQEGEAKTANQLMNDFAEKETLKQKQIDEIRDKKTGLGRIIELKSEILSKKQNELKNVKYELQQLEGSSDRILELDQELIKAERELSKAEKNSNVETLKMEVISLQNEKADLDRTLRKLDQEMEQLNHHTTTRTQMEMLTKDKADKDEQIRKIKSRHSDELTSLLGYFPNKKQLEDWLHSKSKEINQTRDRLAKLNKELASSEQNKNHINNELKRKEEQLSSYEDKLFDVCGSQDFESDLDRLKEEIEKSSKQRAMLAGATAVYSQFITQLTDENQSCCPVCQRVFQTEAELQEVISDLQSKLRLAPDKLKSTESELKKKEKRRDEMLGLVPMRQSIIDLKEKEIPELRNKLQNVNRDIQRLKNDIEEQETLLGTIMPEEESAKVCLTDVTIMERFQMELKDVERKIAQQAAKLQGIDLDRTVQQVNQEKQEKQHKLDTVSSKIELNRKLIQDQQEQIQHLKSTTNELKSEKLQISTNLQRRQQLEEQTVELSTEVQSLYREIKDAKEQVSPLETTLEKFQQEKEELINKKNTSNKIAQDKLNDIKEKVKNIHGYMKDIENYIQDGKDDYKKQKETELNKVIAQLSECEKHKEKINEDMRLMRQDIDTQKIQERWLQDNLTLRKRNEELKEVEEERKQHLKEMGQMQVLQMKSEHQKLEENIDNIKRNHNLALGRQKGYEEEIIHFKKELREPQFRDAEEKYREMMIVMRTTELVNKDLDIYYKTLDQAIMKFHSMKMEEINKIIRDLWRSTYRGQDIEYIEIRSDADENVSASDKRRNYNYRVVMLKGDTALDMRGRCSAGQKVLASLIIRLALAETFCLNCGIIALDEPTTNLDRENIESLAHALVEIIKSRSQQRNFQLLVITHDEDFVELLGRSEYVEKFYRIKKNIDQCSEIVKCSVSSLGFNVH

SEQ ID NO: 849442 - protein, 1312 aa, Homo sapiens; identical to SEQ ID NO: 849434

SEQ ID NO: 849443 - protein, 1213 aa, Homo sapiens
MVCTQKSKKTEFKTLEGVITRTKHGEKVSLSSKCAEIDREMISSLGVSKAVLNNVIFCHQEDSNWPLSEGKALKQKFDEIFSATRYIKALETLRQVRQTQGQKVKEYQMELKYLKQYKEKACEIRDQITSKEAQLTSSKEIVKSYENELDPLKNRLKEIEHNLSKIMKLDNEIKALDSRKKQMEKDNSELEEKMEKVFQGTDEQLNDLYHNHQRTVREKERKLVDCHRELEKLNKESRLLNQEKSELLVEQGRLQLQADRHQEHIRARDSLIQSLATQLELDGFERGPFSERQIKNFHKLVRERQEGEAKTANQLMNDFAEKETLKQKQIDEIRDKKTGLGRIIELKSEILSKKQNELKNVKYELQQLEGSSDRILELDQELIKAERELSKAEKNSNVETLKMEVISLQNEKADLDRTLRKLDQEMEQLNHHTTTRTQMEMLTKDKADKDEQIRKIKSRHSDELTSLLGYFPNKKQLEDWLHSKSKEINQTRDRLAKLNKELASSEQNKNHINNELKRKEEQLSSYEDKLFDVCGSQDFESDLDRLKEEIEKSSKQRAMLAGATAVYSQFITQLTDENQSCCPVCQRVFQTEAELQEVISDLQSKLRLAPDKLKSTESELKKKEKRRDEMLGLVPMRQSIIDLKEKEIPELRNKLQNVNRDIQRLKNDIEEQETLLGTIMPEEESAKVCLTDVTIMERFQMELKDVERKIAQQAAKLQGIDLDRTVQQVNQEKQEKQHKLDTVSSKIELNRKLIQDQQEQIQHLKSTTNELKSEKLQISTNLQRRQQLEEQTVELSTEVQSLYREIKDAKEQVSPLETTLEKFQQEKEELINKKNTSNKIAQDKLNDIKEKVKNIHGYMKDIENYIQDGKDDYKKQKETELNKVIAQLSECEKHKEKINEDMRLMRQDIDTQKIQERWLQDNLTLRKRNEELKEVEEERKQHLKEMGQMQVLQMKSEHQKLEENIDNIKRNHNLALGRQKGYEEEIIHFKKELREPQFRDAEEKYREMMIVMRTTELVNKDLDIYYKTLDQAIMKFHSMKMEEINKIIRDLWRSTYRGQDIEYIEIRSDADENVSASDKRRNYNYRVVMLKGDTALDMRGRCSAGQKVLASLIIRLALAETFCLNCGIIALDEPTTNLDRENIESLAHALVEIIKSRSQQRNFQLLVITHDEDFVELLGRSEYVEKFYRIKKNIDQCSEIVKCSVSSLGFNVH

SEQ ID NO: 849444 - protein, 1364 aa, Homo sapiens
MSRIEKMSILGVRSFGIEDKDKQIITFFSPLTILVGPNGAGKTTIIECLKYICTGDFPPGTKGNTFVHDPKVAQETDVRAQIRLQFRDVNGELIAVQRSMVCTQKSKKTEFKTLEGVITRTKHGEKVSLSSKCAEIDREMISSLGVSKAVLNNVIFCHQEDSNWPLSEGKALKQKFDEIFSATRYIKALETLRQVRQTQGQKVKEYQMELKYLKQYKEKACEIRDQITSKEAQLTSSKEIVKSYENELDPLKNRLKEIEHNLSKIMKLDNEIKALDSRKKQMEKDNSELEEKMEKVFQGTDEQLNDLYHNHQRTVREKERKLVDCHRELEKLNKESRLLNQEKSELLVEQGRLQLQADRHQEHIRARDSLIQSLATQLELDGFERGPFSERQIKNFHKLVRERQEGEAKTANQLMNDFAEKETLKQKQIDEIRDKKTGLGRIIELKSEILSKKQNELKNVKYELQQLEGSSDRILELDQELIKAERELSKAEKNSNVETLKMEVISLQNEKADLDRTLRKLDQEMEQLNHHTTTRTQMEMLTKDKADKDEQIRKIKSRHSDELTSLLGYFPNKKQLEDWLHSKSKEINQTRDRLAKLNKELASSEQNKNHINNELKRKEEQLSSYEDKLFDVCGSQDFESDLDRLKEEIEKSSKQRGKLSTLYYQDTLTPLNFHSQVTVKDGEFKNLVMEPNGLDFSPGSTTYSLCDFAMLAGATAVYSQFITQLTDENQSCCPVCQRVFQTEAELQEVISDLQSKLRLAPDKLKSTESELKKKEKRRDEMLGLVPMRQSIIDLKEKEIPELRNKLQNVNRDIQRLKNDIEEQETLLGTIMPEEESAKVCLTDVTIMERFQMELKDVERKIAQQAAKLQGIDLDRTVQQVNQEKQEKQHKLDTVSSKIELNRKLIQDQQEQIQHLKSTTNELKSEKLQISTNLQRRQQLEEQTVELSTEVQSLYREIKDAKEQVSPLETTLEKFQQEKEELINKKNTSNKIAQDKLNDIKEKVKNIHGYMKDIENYIQDGKDDYKKQKETELNKVIAQLSECEKHKEKINEDMRLMRQDIDTQKIQERWLQDNLTLRKRNEELKEVEEERKQHLKEMGQMQVLQMKSEHQKLEENIDNIKRNHNLALGRQKGYEEEIIHFKKELREPQFRDAEEKYREMMIVMRTTELVNKDLDIYYKTLDQAIMKFHSMKMEEINKIIRDLWRSTYRGQDIEYIEIRSDADENVSASDKRRNYNYRVVMLKGDTALDMRGRCSAGQKVLASLIIRLALAETFCLNCGIIALDEPTTNLDRENIESLAHALVEIIKSRSQQRNFQLLVITHDEDFVELLGRSEYVEKFYRIKKNIDQCSEIVKCSVSSLGFNVH

SEQ ID NO: 849445 - protein, 534 aa, Homo sapiens
MPEEESAKVCLTDVTIMERFQMELKDVERKIAQQAAKLQGIDLDRTVQQVNQEKQEKQHKLDTVSSKIELNRKLIQDQQEQIQHLKSTTNELKSEKLQISTNLQRRQQLEEQTVELSTEVQSLYREIKDAKEQVSPLETTLEKFQQEKEELINKKNTSNKIAQDKLNDIKEKVKNIHGYMKDIENYIQDGKDDYKKQKETELNKVIAQLSECEKHKEKINEDMRLMRQDIDTQKIQERWLQDNLTLRKRNEELKEVEEERKQHLKEMGQMQVLQMKSEHQKLEENIDNIKRNHNLALGRQKGYEEEIIHFKKELREPQFRDAEEKYREMMIVMRTTELVNKDLDIYYKTLDQAIMKFHSMKMEEINKIIRDLWRSTYRGQDIEYIEIRSDADENVSASDKRRNYNYRVVMLKGDTALDMRGRCSAGQKVLASLIIRLALAETFCLNCGIIALDEPTTNLDRENIESLAHALVEIIKSRSQQRNFQLLVITHDEDFVELLGRSEYVEKFYRIKKNIDQCSEIVKCSVSSLGFNVH

SEQ ID NO: 849446 - protein, 1312 aa, Homo sapiens; identical to SEQ ID NO: 849434

SEQ ID NO: 849447 - protein, 188 aa, Homo sapiens
RFPADVVEENESGRGQDWRSCRFRRGAQNAAAASLERGPWGRNPRRARWQHTLGPPLPAASPEDGQQRNKKMDSLAAGELNASHQPWVPEFVAYWRKTHQDHLCSLHSRAFGLLDARVTWALRRAPEPVPGKDRLLLAAFPAEASPVDTASVSVYGRAPRYMHKGVKKCVCTPVSKNSTAWLLLGGIS

SEQ ID NO: 849448 - protein, 499 aa, Homo sapiens
SRLYDRKYGIGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 849449 - protein, 104 aa, Homo sapiens [sequence omitted]

SEQ ID NO: 849450 - protein, 244 aa, Homo sapiens
MIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRPWSSLQTMLLSKQ

SEQ ID NO: 849451 - protein, 499 aa, Homo sapiens; identical to SEQ ID NO: 849448

SEQ ID NO: 849452 - protein, 480 aa, Homo sapiens
MIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 849453 - protein, 494 aa, Homo sapiens
QIDDRRLWRRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 849454 - protein, 481 aa, Homo sapiens
MTSSPRAPPGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 849455 - protein, 398 aa, Homo sapiens
PHRGNSGLNIYNLYAPCAGGVPSHFRYEKYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 849456 - protein, 157 aa, Homo sapiens
KQAVRPEVWDWRARTRGSRDDPSRAAAAVPAAAAAAAASVLGVPRRGSPRPGRDPAPPRAGQAAVFPPVLRLPQRLRLQAPPLLVCGVPEGSREQPCGALAQWGSRLQLTRWAPHRAWPLPGPARWCHPGVQPLFLESDCQCVIPGVPSWGGLLLLR

SEQ ID NO: 849457 - protein, 368 aa, Homo sapiens
SRLYDRKYGIGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTSSGQPTGRWWTDCN

SEQ ID NO: 849458 - protein, 263 aa, Homo sapiens
LGQRTVWGQRTVLGQRTVLGQRTVWANAPCWANAPCWANAPCLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 849459 - protein, 283 aa, Homo sapiens
SRLYDRKYGIGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNGPFSA

SEQ ID NO: 849460 - protein, 110 aa, Homo sapiens
RAYNGAGTPTIVILLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 849461 - protein, 186 aa, Homo sapiens
SRLYDRKYGIGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEPFKISSFGNQVG

SEQ ID NO: 849462 - protein, 187 aa, Homo sapiens
SRLYDRKYGIGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNEALYDCLIRGYRARF

SEQ ID NO: 849463 - protein, 104 aa, Homo sapiens [sequence omitted]

SEQ ID NO: 849464 - protein, 148 aa, Homo sapiens
IANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNVRFCHHFA

SEQ ID NO: 849465 - protein, 480 aa, Homo sapiens; identical to SEQ ID NO: 849452

SEQ ID NO: 849466 - protein, 488 aa, Homo sapiens
TAVATAWPFIPPAPAKGHQGHVSVPPPVYSLLHEPCLPAHPRTGGSTRSRGEGLSQEVRVHVLRSCPSSPRLVFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 849467 - protein, 435 aa, Homo sapiens
SRLYDRKYGIGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGRCRTLALQIFQWGGTQIRG

SEQ ID NO: 849468 - protein, 436 aa, Homo sapiens
SRLYDRKYGIGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVGPTLGQRTVCWGGHPGFTERTQVRTWLPVTGLLVTELPVTGPAAAASCSALWSAPKLPRAAPRRLRVEAGS

SEQ ID NO: 849469 - protein, 398 aa, Homo sapiens
SRLYDRKYGIGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVGPTLGQRTVQFVPFQFYSDCCDLVRCVPQRYEL

SEQ ID NO: 849470 - protein, 241 aa, Homo sapiens
LGQRTVWGQRTVLGQRTVLGQRTVWANAPCWANAPCWANAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 849471 - protein, 269 aa, Homo sapiens
SRLYDRKYGIGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYD

SEQ ID NO: 849472 - protein, 208 aa, Homo sapiens
MIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQVQGSCRRE

SEQ ID NO: 849473 - protein, 126 aa, Homo sapiens
SRLYDRKYGIGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLGPFSA

SEQ ID NO: 849474 - protein, 325 aa, Homo sapiens
RHKGLKKTHFIKNMRQYDTRNSRIVLICAKRSLCAAFSVLPYGEGLRISDLRVDSQKQRHPSGGVSVSSEMVFELEGVELGADGKVVSYAKFLYPTNALVTHKSDSHGLLPTPRPSVPRTLPGPRHKPAPTKSAPASTELGSDVGDTLEYNPNLLDDPQWPCGKHKRVLIFASYMTTVIEYVKPSDLKKDMNETFREKFPHVKLTLSKIRSLKREMRSLSEECSLEPVTVAMAYVYFEKLVLQGKLSKQNRKLCAGACVLLAAKISSDLRKSGVKQLIDKLEERFRFNRRDLIGFEFTVLVALELALYLPENQVLPHYRRLTQQF

SEQ ID NO: 849475 - protein, 255 aa, Homo sapiens
MVFELEGVELGADGKVVSYAKFLYPTNALVTHKSDSHGLLPTPRPSVPRTLPGPRHKPAPTKSAPASTELGSDVGDTLEYNPNLLDDPQWPCGKHKRVLIFASYMTTVIEYVKPSDLKKDMNETFREKFPHVKLTLSKIRSLKREMRSLSEECSLEPVTVAMAYVYFEKLVLQGKLSKQNRKLCAGACVLLAAKISSDLRKSGVKQLIDKLEERFRFNRRDLIGFEFTVLVALELALYLPENQVLPHYRRLTQQF

SEQ ID NO: 849476 - protein, 325 aa, Homo sapiens; identical to SEQ ID NO: 849474

SEQ ID NO: 849477 - protein, 325 aa, Homo sapiens; identical to SEQ ID NO: 849474

SEQ ID NO: 849478 - protein, 118 aa, Homo sapiens
CAGACVLLAAKISSDLRKSGVKQLIDVSARLGRHCRQGHDIEPGPLLEMGLAGWEMWKREGSRVTLLSSPLQKLEERFRFNRRDLIGFEFTVLVALELALYLPENQVLPHYRRLTQQF

SEQ ID NO: 849479 - protein, 187 aa, Homo sapiens
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGELRHECKGQ

SEQ ID NO: 849480 - protein, 285 aa, Homo sapiens
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKKFHTVSGSKCEIKVAQPKEVYQQQQYGSGGRGNRNRGNRGSGGGGGGGGQGSTNYGKSQRRGGHQNNYKPY

SEQ ID NO: 849481 - protein, 285 aa, Homo sapiens; identical to SEQ ID NO: 849480

SEQ ID NO: 849482 - protein, 332 aa, Homo sapiens
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKKFHTVSGSKCEIKVAQPKEVYQQQQYGSGGRGNRNRGNRGSGGGGGGGGQSQSWNQGYGNYWNQGYGYQQGYGPGYGGYDYSPYGYYGYGPGYDYSQGSTNYGKSQRRGGHQNNYKPY

SEQ ID NO: 849483 - protein, 332 aa, Homo sapiens; identical to SEQ ID NO: 849482

SEQ ID NO: 849484 - protein, 332 aa, Homo sapiens; identical to SEQ ID NO: 849482

SEQ ID NO: 849485 - protein, 285 aa, Homo sapiens; identical to SEQ ID NO: 849480

SEQ ID NO: 849486 - protein, 285 aa, Homo sapiens; identical to SEQ ID NO: 849480

SEQ ID NO: 849487 - protein, 312 aa, Homo sapiens
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKNQQQQYGSGGRGNRNRGNRGSGGGGGGGGQSQSWNQGYGNYWNQGYGYQQGYGPGYGGYDYSPYGYYGYGPGYDYSQGSTNYGKSQRRGGHQNNYKPY

SEQ ID NO: 849488 - protein, 332 aa, Homo sapiens; identical to SEQ ID NO: 849482

SEQ ID NO: 849489 - protein, 332 aa, Homo sapiens; identical to SEQ ID NO: 849482

SEQ ID NO: 849490 - protein, 377 aa, Homo sapiens
FNWPQFCRLYRKHDAGIYSASREASGNLQSWQNVKQEPALHMAGAGEKAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKKFHTVSGSKCEIKVAQPKEVYQQQQYGSGGRGNRNRGNRGSGGGGGGGGQSQSWNQGYGNYWNQGYGYQQGYGPGYGGYDYSPYGYYGYGPGYDYSQGSTNYGKSQRRGGHQNNYKPY

SEQ ID NO: 849491 - protein, 245 aa, Homo sapiens
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKKFHTVSGSKVRCSQLCLASCAAGELALRGMG

SEQ ID NO: 849492 - protein, 352 aa, Homo sapiens
MSEAGEEQPMETTGATENGHEAVPEGESPAGAGTGAAAGAGGATAAPPSGNQNGAEGDQINASKNEEDAGTQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKKFHTVSGSKCEIKVAQPKEVYQQQQYGSGGRGNRNRGNRGSGGGGGGGGQSQSWNQGYGNYWNQGYGYQQGYGPGYGGYDYSPYGYYGYGPGYDYSQGSTNYGKSQRRGGHQNNYKPY

SEQ ID NO: 849493 - protein, 125 aa, Homo sapiens
MQGWAQGPYTPEQQPLGFCLSCHSNPATPKGRISSILAPAYAKWSTGPCALLPPTGQSQSWNQGYGNYWNQGYGYQQGYGPGYGGYDYSPYGYYGYGPGYDYSQGSTNYGKSQRRGGHQNNYKPY

SEQ ID NO: 849494 - protein, 177 aa, Homo sapiens
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIRLLGVGG

SEQ ID NO: 849495 - protein, 152 aa, Homo sapiens
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVSWVLDFSSLSGNDLNSKRTPFLKHD

SEQ ID NO: 849496 - protein, 200 aa, Homo sapiens
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGELRHECKGKCTQRGGLLKKRKV

SEQ ID NO: 849497 - protein, 285 aa, Homo sapiens; identical to SEQ ID NO: 849480

SEQ ID NO: 849498 - protein, 332 aa, Homo sapiens; identical to SEQ ID NO: 849482

SEQ ID NO: 849499 - protein, 332 aa, Homo sapiens; identical to SEQ ID NO: 849482

SEQ ID NO: 849500 - protein, 332 aa, Homo sapiens; identical to SEQ ID NO: 849482

SEQ ID NO: 849501 - protein, 311 aa, Homo sapiens
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKKFHTVSGSKCEIKVAQPKEVYQQQQYGSGGRGNRNRGNRGSGGGGGGGGQSQSWNQGYGNYWNQGYGYQQGYGPGYGGYDYSPYGYYGYGPGYDYSK

SEQ ID NO: 849502 - protein, 262 aa, Homo sapiens
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKKFHTVSGSKCEIKVAQPKEVYQQQQYGSGGRGNRNRGNREPATWWPSE

SEQ ID NO: 849503 - protein, 332 aa, Homo sapiens; identical to SEQ ID NO: 849482

SEQ ID NO: 849504 - protein, 299 aa, Homo sapiens
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKKFHTVSGSKCEIKVAQPKEVYQQQQYGSGGRGNRNRGNRGSGGGGGGGGEWNVDEDRSCFPAYMEPSKPVLGLPLVLCSRGGQIV

SEQ ID NO: 849505 - protein, 257 aa, Homo sapiens
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKKFHTVSGSKCEIKVAQPKEVYRWEALLPAAALQPGPVDPGCKE

SEQ ID NO: 849506 - protein, 261 aa, Homo sapiens [sequence omitted]

SEQ ID NO: 849507 - protein, 139 aa, Homo sapiens
RTRGSTHASIFVGGLNPEATEEKIREYFGEFGEIEAIELPMDPKLNKRRGFVFITFKEEEPVKKVLEKKFHTVSGSKCEIKVAQPKEVYQQQQYGSGGRGNRNRGNRGSGGGGGGGGQGSTNYGKSQRRGGHQNNYKPY

SEQ ID NO: 849508 - protein, 104 aa, Homo sapiens
MQGWAQGPYTPEQQPLGFCLSCHSNPATPKGRISSILAPAYAKWSTGPCALLPPTGQSQSWNQGYGNYWNQGYGYQQGYGPGYGGYDYSPYGYYGYGPGYDYSK

SEQ ID NO: 849509 - protein, 141 aa, Homo sapiens
MKRRGFVFITFKEEEPVKKVLEKKFHTVSGSKCEIKVAQPKEVYQQQQYGSGGRGNRNRGNRGSGGGGGGGGQSQSWNQGYGNYWNQGYGYQQGYGPGYGGYDYSPYGYYGYGPGYDYSQGSTNYGKSQRRGGHQNNYKPY

SEQ ID NO: 849510 - protein, 174 aa, Homo sapiens
GRGRTGAPPLFRGRLLLAPRGGGRGGGLARVGAGAARGLSPLRSRAGPGAATRAGVCGSLLGRLWRRPGAARALPGPGPGPEPAQGRADGPEEGKRSDPGPGGVLGRAGGCVGGVGASRGPDLPPPPLPGAESRSEPWAGLVPGNIEFLETSSQELVETLALCYMVVEHMNFQL

SEQ ID NO: 849511 - protein, 298 aa, Homo sapiens
MVRMVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQRAKAYLEEECPATLRKYLKYSKNILDRQDPPSVVVTSHQAPGEKKKLKCLAYDFYPGKIDVHWTRAGEVQEPELRGDVLHNGNGTYQSWVVVAVPPQDTAPYSCHVQHSSLAQPLVVPWEAS

SEQ ID NO: 849512 - protein, 115 aa, Homo sapiens
EETWAGRSPPQACSVTLYPSTDPPSVVVTSHQAPGEKKKLKCLAYDFYPGKIDVHWTRAGEVQEPELRGDVLHNGNGTYQSWVVVAVPPQDTAPYSCHVQHSSLAQPLVVPWEAS

SEQ ID NO: 849513 - protein, 298 aa, Homo sapiens; identical to SEQ ID NO: 849511

SEQ ID NO: 849514 - protein, 295 aa, Homo sapiens
MVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQRAKAYLEEECPATLRKYLKYSKNILDRQDPPSVVVTSHQAPGEKKKLKCLAYDFYPGKIDVHWTRAGEVQEPELRGDVLHNGNGTYQSWVVVAVPPQDTAPYSCHVQHSSLAQPLVVPWEAS

SEQ ID NO: 849515 - protein, 295 aa, Homo sapiens; identical to SEQ ID NO: 849514

SEQ ID NO: 849516 - protein, 300 aa, Homo sapiens
MVRMVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQRAKAYLEEECPATLRKYLKYSKNILDRQDPPSVVVTSHQAPGEKKKLKCLAYDFYPGGRCSSQWKWHLPVLGGGGSAPAGHSPLLLPRAAQQPGPAPRGALGGQLGSKGWRQCGISDPVAALPA

SEQ ID NO: 849517 - protein, 235 aa, Homo sapiens
MVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQRAKAYLEEECPATLRGDVLHNGNGTYQSWVVVAVPPQDTAPYSCHVQHSSLAQPLVVPWEAS

SEQ ID NO: 849518 - protein, 230 aa, Homo sapiens
MVRMVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQRAKAYLEEECPATLRKYLKYSKNILDRQGTHCFLLPSTEPRIKDDLRLGAQATS

SEQ ID NO: 849519 - protein, 197 aa, Homo sapiens
MVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQHGALVSDVNEHRRDMAMARGLEMH

SEQ ID NO: 849520 - protein, 131 aa, Homo sapiens
MVRMVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNVPGRSLAQEKQRPVGPRDA

SEQ ID NO: 849521 - protein, 295 aa, Homo sapiens; identical to SEQ ID NO: 849514

SEQ ID NO: 849522 - protein, 295 aa, Homo sapiens
MESKKTLLHRLCYHAIPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQRAKAYLEEECPATLRKYLKYSKNILDRQDPPSVVVTSHQAPGEKKKLKCLAYDFYPGKIDVHWTRAGEVQEPELRGDVLHNGNGTYQSWVVVAVPPQDTAPYSCHVQHSSLAQPLVVPWEAS

SEQ ID NO: 849523 - protein, 295 aa, Homo sapiens; identical to SEQ ID NO: 849514

SEQ ID NO: 849524 - protein, 295 aa, Homo sapiens; identical to SEQ ID NO: 849514

SEQ ID NO: 849525 - protein, 249 aa, Homo sapiens
MVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQRAKAYLEEECPATLRKYLKYSKNILDRQDPPSVVVTSHQAPGEKKKLKCLAYDFYPGMVFTMKWELPLGCGCNPPA

SEQ ID NO: 849526 - protein, 188 aa, Homo sapiens
MVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQHSSLAQPLVVPWEAS

SEQ ID NO: 849527 - protein, 155 aa, Homo sapiens
MVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYSCLMWELNHRNHSQWIHKA

SEQ ID NO: 849528 - protein, 111 aa, Homo sapiens
MVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGQ

SEQ ID NO: 849529 - protein, 136 aa, Homo sapiens
QVAVMTGRDVLPALEGLPVCEDSRAIHGEQKGPLGLSTAGISPCSKHRLGGQAHGTDSGPDTTTSWGSPGQATLLGAVRIKQGRVSWQLGLAASVCIRNGSGCPAAITAAVVRTDILSPWVSFDPRPEPKVPSNLG

SEQ ID NO: 849530 - protein, 828 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 849531 - protein, 828 aa, Homo sapiens; identical to SEQ ID NO: 849530

SEQ ID NO: 849532 - protein, 828 aa, Homo sapiens; identical to SEQ ID NO: 849530

SEQ ID NO: 849533 - protein, 828 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVGTLRPDEKAIMTYVSCFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 849534 - protein, 650 aa, Homo sapiens
MYEARVLIGRGKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 849535 - protein, 828 aa, Homo sapiens; identical to SEQ ID NO: 849530

SEQ ID NO: 849536 - protein, 823 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKKQTGSMDSDDFRALLISTGYSLGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 849537 - protein, 575 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKPTSTCAASSPARPMLWGPGSRPRWRRSGASPLR

SEQ ID NO: 849538 - protein, 772 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETRPGRVLHRPHGAIPGP

SEQ ID NO: 849539 - protein, 243 aa, Homo sapiens [sequence omitted]

SEQ ID NO: 849540 - protein, 828 aa, Homo sapiens; identical to SEQ ID NO: 849530

SEQ ID NO: 849541 - protein, 828 aa, Homo sapiens; identical to SEQ ID NO: 849530

SEQ ID NO: 849542 - protein, 828 aa, Homo sapiens; identical to SEQ ID NO: 849530

SEQ ID NO: 849543 - protein, 875 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPPHPTSPGLALSGLTCLRFSKNQKKKREKKHKTTKTKKKKNHKNKKTIKKKELKTFRELLFTLLTYGFII

SEQ ID NO: 849544 - protein, 837 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPHPIPPAPALLCLASRVSDFLRTKKKKGKKNTKQQKPKKKKITKTKKL

SEQ ID NO: 849545 - protein, 828 aa, Homo sapiens; identical to SEQ ID NO: 849530

SEQ ID NO: 849546 - protein, 798 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKVAGPGKMDSRGEHRQDRRERPY

SEQ ID NO: 849547 - protein, 775 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETRPNTPDGLQEGLMAWLPGG

SEQ ID NO: 849548 - protein, 713 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKVSSLPPPRPLPSRRCRT

SEQ ID NO: 849549 - protein, 707 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKMMGLLMALPSM

SEQ ID NO: 849550 - protein, 632 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYEQQCRYEQRCRYEQQCSMNHSA

SEQ ID NO: 849551 - protein, 606 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIAQSVRGDSSRDDHQPSP

SEQ ID NO: 849552 - protein, 570 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQLMAWLPGG

SEQ ID NO: 849553 - protein, 533 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPFFLSLF

SEQ ID NO: 849554 - protein, 309 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDILLAGDTGPL

SEQ ID NO: 849555 - protein, 127 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFHALDTPTPEWRP

SEQ ID NO: 849556 - protein, 166 aa, Homo sapiens
MAGASVCAAEVILLVPRAPDRYHSERPSPRMFPLVPNDRRTFDHYQILSDSPLAAPADRQLLRTLVLLSSCTEDPLTMEEIGRISIEMNGTLEDQLSHLKQYERSIVDYKPNLDLLEQQHQLIQEALIFDNKHTNYTMEVRGCPARWPFHQHGRLPHWKWFGPVRR

SEQ ID NO: 849557 - protein, 828 aa, Homo sapiens; identical to SEQ ID NO: 849530

SEQ ID NO: 849558 - protein, 854 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEVRTPRPPIFPRASVGLGRPLTPAPPQGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 849559 - protein, 428 aa, Homo sapiens
MRSAGWSGSTTCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 849560 - protein, 828 aa, Homo sapiens; identical to SEQ ID NO: 849530

SEQ ID NO: 849561 - protein, 828 aa, Homo sapiens; identical to SEQ ID NO: 849530

SEQ ID NO: 849562 - protein, 828 aa, Homo sapiens; identical to SEQ ID NO: 849530

SEQ ID NO: 849563 - protein, 828 aa, Homo sapiens; identical to SEQ ID NO: 849530

SEQ ID NO: 849564 - protein, 788 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGHPIPPAPALLCLASRVSDFLRTKKKKGKKNTKQQKPKKKKITKTKKL

SEQ ID NO: 849565 - protein, 844 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGVGLWGPSRGGGGLMAWLPGG

SEQ ID NO: 849566 - protein, 799 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAYGAAGEKLWTAGRTPLDV

SEQ ID NO: 849567 - protein, 546 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPTPSHQPRPCFVWPHVSQIF

SEQ ID NO: 849568 - protein, 439 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAMRGASRGRHQPPDGWGPTQPLSPLCSRLTCHCQEMAPTSTPLLQQRS

SEQ ID NO: 849569 - protein, 591 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEVRHG

SEQ ID NO: 849570 - protein, 417 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNTPSHQPRPCFVWPHVSQIF

SEQ ID NO: 849571 - protein, 438 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEVRRG

SEQ ID NO: 849572 - protein, 117 aa, Homo sapiens
EDPCPSPFVGERLPKPERGKMRVHKINNVNKALDFIASKGVKLVSIGAEEIVDGNAKMTLGMIWTIILRFAIQDISVEETSAKEGLLLWCQRKTAPYKNVNVQNFHIRPRPGHRPCH

SEQ ID NO: 849573 - protein, 306 aa, Homo sapiens
TGTPRRLAAPSLYPAPDPGSERRPRCPGTPLAGRMADPGPDPESESESVFPREVGLFADSYSEKSQFCFCGHVLTITQNFGSRLGVAARVWDAALSLCNYFESQNVDFRGKKVIELGAGTGIVGILAALQGAYGLVRETEDDVIEQELWRGMRGACGHALSMSTMTPWESIKGSSVRGDVTITDLPLALEQIQGNVQANVPAGGQAQVRALSWGIDHHVFPANYDLVLGADIVYLEPTFPLLLGTLQHLCRPHGTIYLASKMRKEHGTESFFQHLLPQHFQLELAQRDEDENVNIYRARHREPRPA

SEQ ID NO: 849574 - protein, 256 aa, Homo sapiens
CRLKKSSRGEDCVPPASRWHHTRLVRSAGEFWPFRRAVGLLPHQCARRRVFIAAREMSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAIVLRTHHICMI

SEQ ID NO: 849575 - protein, 131 aa, Homo sapiens
CRLKKSSRGEDCVPPASRWHHTRLVRSAGEFWPFRRAVGLLPHQCARRRVFIAAREMSLLRSLRVFLVARTGSYPVRSPGAGTDLLSLQLSCAPVPFPSSQPRLTPSHLPRQHCLCPVQPRCTPLCTLSAP

SEQ ID NO: 849576 - protein, 153 aa, Homo sapiens
TGTPRRLAAPSLYPAPDPGSERRPRCPGTPLAGRMADPGPDPESESESVFPREVGLFADSYSEKSQFCFCGHVLTITQNFGSRLGVAARVWDAALSLCNYFESQNVDFRGKKVIELGAGTGIVGILAALQAPQSKPPRSLAWTTTTATLVFLL

SEQ ID NO: 849577 - protein, 381 aa, Homo sapiens
CRLKKSSRGEDCVPPASRWHHTRLVRSAGEFWPFRRAVGLLPHQCARRRVFIAAREMSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAIGKLGENMILKRAAWVKVPSGFYVGSYVHGAMQSPSLHKLVLGKYGALVICETSEQKTNLEDVGRRLGQHVVGMAPLSVGSLDDEPGGEAETKMLSQPYLLDPSITLGQYVQPQGVSVVDFVRFECGEGEEAAETE

SEQ ID NO: 849578 - protein, 381 aa, Homo sapiens; identical to SEQ ID NO: 849577

SEQ ID NO: 849579 - protein, 381 aa, Homo sapiens; identical to SEQ ID NO: 849577

SEQ ID NO: 849580 - protein, 275 aa, Homo sapiens
MKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAIGKLGENMILKRAAWVKVPSGFYVGSYVHGAMQSPSLHKLVLGKYGALVICETSEQKTNLEDVGRRLGQHVVGMAPLSVGSLDDEPGGEAETKMLSQPYLLDPSITLGQYVQPQGVSVVDFVRFECGEGEEAAETE

SEQ ID NO: 849581 - protein, 285 aa, Homo sapiens
MVYCTTTWAIWNCQLLLGYKPLQNVTGLNTVGSCNTVAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAIGKLGENMILKRAAWVKVPSGFYVGSYVHGAMQSPSLHKLVLGKYGALVICETSEQKTNLEDVGRRLGQHVVGMAPLSVGSLDDEPGGEAETKMLSQPYLLDPSITLGQYVQPQGVSVVDFVRFECGEGEEAAETE

SEQ ID NO: 849582 - protein, 260 aa, Homo sapiens
TGTPRRLAAPSLYPAPDPGSERRPRCPGTPLAGRMADPGPDPESESESVFPREVGLFADSYSEKSQFCFCGHVLTITQNFGSRLGVAARVWDAALSLCNYFESQNVDFRGKKVIELGAGTGIVGILAALQGGDVTITDLPLALEQIQGNVQANVPAGGQAQVRALSWGIDHHVFPANYDLVLGADIVYLEPTFPLLLGTLQHLCRPHGTIYLASKMRKEHGTESFFQHLLPQHFQLELAQRDEDENVNIYRARHREPRPA

SEQ ID NO: 849583 - protein, 260 aa, Homo sapiens; identical to SEQ ID NO: 849582

SEQ ID NO: 849584 - protein, 116 aa, Homo sapiens
TGTPRRLAAPSLYPAPDPGSERRPRCPGTPLAGRMADPGPDPESESESVFPREVGLFADSYSEKSQFCFCGHVLTITQNFGSRLGVAARVWDAALSLCNYFESQNVDFRGKKELMV

SEQ ID NO: 849585 - protein, 185 aa, Homo sapiens
CRLKKSSRGEDCVPPASRWHHTRLVRSAGEFWPFRRAVGLLPHQCARRRVFIAAREMSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEPPLCWLPGR

SEQ ID NO: 849586 - protein, 81 aa, Homo sapiens
ILWVIVALILSEWSEELWYSSDQSISSGFTGLLERRHKKHEKALSLCNYFESQNVDFRGKKVIELGAGTGIVGILAALQGA

SEQ ID NO: 849587 - protein, 381 aa, Homo sapiens; identical to SEQ ID NO: 849577

SEQ ID NO: 849588 - protein, 381 aa, Homo sapiens; identical to SEQ ID NO: 849577

SEQ ID NO: 849589 - protein, 275 aa, Homo sapiens; identical to SEQ ID NO: 849580

SEQ ID NO: 849590 - protein, 402 aa, Homo sapiens
CRLKKSSRGEDCVPPASRWHHTRLVRSAGEFWPFRRAVGLLPHQCARRRVFIAAREMSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKVQWLTPVNLALWEAEAGGSLEGFLNSSELSGLPAGPDREGSLKDQLALAIGKLGENMILKRAAWVKVPSGFYVGSYVHGAMQSPSLHKLVLGKYGALVICETSEQKTNLEDVGRRLGQHVVGMAPLSVGSLDDEPGGEAETKMLSQPYLLDPSITLGQYVQPQGVSVVDFVRFECGEGEEAAETE

SEQ ID NO: 849591 - protein, 152 aa, Homo sapiens
HLQLPLFISKESGSHMQITKRVSLCCFLLCFLVSPPGAAQGPQELSLVPNSHEAKLVLGKYGALVICETSEQKTNLEDVGRRLGQHVVGMAPLSVGSLDDEPGGEAETKMLSQPYLLDPSITLGQYVQPQGVSVVDFVRFECGEGEEAAETE

SEQ ID NO: 849592 - protein, 95 aa, Homo sapiens
GRRKGLGGRTESFTPGGVGAATGPRRERGEKAAAPCSPSSRPNPPSGPTSCHRPRLTIRSIRNRKCWDYRREPLRLATFLKLAFKFKICAKKRCY

SEQ ID NO: 849593 - protein, 777 aa, Homo sapiens
MFSLKPPKPTFRSYLLPPPQTDDKINSEPKIKKLEPVLLPGEIVVNEVNFVRKCIATDTSQYDLWGKLICSNFKISFITDDPMPLQKFHYRNLLLGEHDVPLTCIEQIVTVNDHKRKQKVLGPNQKLKFNPTELIIYCKDFRIVRFRFDESGPESAKKVCLAIAHYSQPTDLQLLFAFEYVGKKYHNSANKINGIPSGDGGGGGGGGNGAGGGSSQKTPLFETYSDWDREIKRTGASGWRVCSINEGYMISTCLPEYIVVPSSLADQDLKIFSHSFVGRRMPLWCWSHSNGSALVRMALIKDVLQQRKIDQRICNAITKSHPQRSDVYKSDLDKTLPNIQEVQAAFVKLKQLCVNEPFEETEEKWLSSLENTRWLEYVRAFLKHSAELVYMLESKHLSVVLQEEEGRDLSCCVASLVQVMLDPYFRTITGFQSLIQKEWVMAGYQFLDRCNHLKRSEKESPLFLLFLDATWQLLEQYPAAFEFSETYLAVLYDSTRISLFGTFLFNSPHQRVKQSTEFAISKNIQLGDEKGLKFPSVWDWSLQFTAKDRTLFHNPFYIGKSTPCIQNGSVKSFKRTKKSYSSTLRGMPSALKNGIISDQELLPRRNSLILKPKPDPAQQTDSQNSDTEQYFREWFSKPANLHGVILPRVSGTHIKLWKLCYFRWVPEAQISLGGSITAFHKLSLLADEVDVLSRMLRQQRSGPLEACYGELGQSRMYFNASGPHHTDTSGTPEFLSSSFPFSPVGNLCRRSILGTPLSKFLSGAKIWLSTETLANED

SEQ ID NO: 849594 - protein, 791 aa, Homo sapiens
AAERAWAAALRALRPEASALPLARDGNGAKRRRHHVLPQAAQTHLQVLPPATAPGEIVVNEVNFVRKCIATDTSQYDLWGKLICSNFKISFITDDPMPLQKFHYRNLLLGEHDVPLTCIEQIVTVNDHKRKQKVLGPNQKLKFNPTELIIYCKDFRIVRFRFDESGPESAKKVCLAIAHYSQPTDLQLLFAFEYVGKKYHNSANKINGIPSGDGGGGGGGGNGAGGGSSQKTPLFETYSDWDREIKRTGASGWRVCSINEGYMISTCLPEYIVVPSSLADQDLKIFSHSFVGRRMPLWCWSHSNGSALVRMALIKDVLQQRKIDQRICNAITKSHPQRSDVYKSDLDKTLPNIQEVQAAFVKLKQLCVNEPFEETEEKWLSSLENTRWLEYVRAFLKHSAELVYMLESKHLSVVLQEEEGRDLSCCVASLVQVMLDPYFRTITGFQSLIQKEWVMAGYQFLDRCNHLKRSEKESPLFLLFLDATWQLLEQYPAAFEFSETYLAVLYDSTRISLFGTFLFNSPHQRVKQSTEFAISKNIQLGDEKGLKFPSVWDWSLQFTAKDRTLFHNPFYIGKSTPCIQNGSVKSFKRTKKSYSSTLRGMPSALKNGIISDQELLPRRNSLILKPKPDPAQQTDSQNSDTEQYFREWFSKPANLHGVILPRVSGTHIKLWKLCYFRWVPEAQISLGGSITAFHKLSLLADEVDVLSRMLRQQRSGPLEACYGELGQSRMYFNASGPHHTDTSGTPEFLSSSFPFSPVGNLCRRSILGTPLSKFLSGAKIWLSTETLANED

SEQ ID NO: 849595 - protein, 630 aa, Homo sapiens
VCVTSRYSRRNSRPSHPKLKQRQLQQLQLQQLNMLGKNTTIPNKINGIPSGDGGGGGGGGNGAGGGSSQKTPLFETYSDWDREIKRTGASGWRVCSINEGYMISTCLPEYIVVPSSLADQDLKIFSHSFVGRRMPLWCWSHSNGSALVRMALIKDVLQQRKIDQRICNAITKSHPQRSDVYKSDLDKTLPNIQEVQAAFVKLKQLCVNEPFEETEEKWLSSLENTRWLEYVRAFLKHSAELVYMLESKHLSVVLQEEEGRDLSCCVASLVQVMLDPYFRTITGFQSLIQKEWVMAGYQFLDRCNHLKRSEKESPLFLLFLDATWQLLEQYPAAFEFSETYLAVLYDSTRISLFGTFLFNSPHQRVKQSTEFAISKNIQLGDEKGLKFPSVWDWSLQFTAKDRTLFHNPFYIGKSTPCIQNGSVKSFKRTKKSYSSTLRGMPSALKNGIISDQELLPRRNSLILKPKPDPAQQTDSQNSDTEQYFREWFSKPANLHGVILPRVSGTHIKLWKLCYFRWVPEAQISLGGSITAFHKLSLLADEVDVLSRMLRQQRSGPLEACYGELGQSRMYFNASGPHHTDTSGTPEFLSSSFPFSPVGNLCRRSILGTPLSKFLSGAKIWLSTETLANED

SEQ ID NO: 849596 - protein, 706 aa, Homo sapiens
MFSLKPPKPTFRSYLLPPPQTDDKINSEPKIKKLEPVLLPGEIVVNEVNFVRKCIATDTSQYDLWGKLICSNFKISFITDDPMPLQKFHYRNLLLGEHDVPLTCIEQIVTVNDHKRKQKVLGPNQKLKFNPTELIIYCKDFRIVRFRFDESGPESAKKVCLAIAHYSQPTDLQLLFAFEYVGKKYHNSANKINGIPSGDGGGGGGGGNGAGGGSSQKTPLFETYSDWDREIKRTGASGWRVCSINEGYMISTCLPEYIVVPSSLADQDLKIFSHSFVGRRMPLWCWSHSNGSALVRMALIKDVLQQRKIDQRICNAITKSHPQRSDVYKSDLDKTLPNIQEVQAAFVKLKQLCVNEPFEETEEKWLSSLENTRWLEYVRAFLKHSAELVYMLESKHLSVVLQEEEGRDLSCCVASLVQVMLDPYFRTITGFQSLIQKEWVMAGYQFLDRCNHLKRSEKESPLFLLFLDATWQLLEQYPAAFEFSETYLAVLYDSTRISLFGTFLFNSPHQRVKQSTEFAISKNIQLGDEKGLKFPSVWDWSLQFTAKDRTLFHNPFYIGKSTPCIQNGSVKSFKRTKKSYSSTLRGMPSALKNGIISDQELLPRRNSLILKPKPDPALQELLFLCLYIFIFPFWKWSLTLSPRLVCSGAISAHCNLYLPGSGNSPDSASQVAGITGTCHHTRLIFVFLVETGFYHIGQAGLELLIL

SEQ ID NO: 849597 - protein, 667 aa, Homo sapiens
MFSLKPPKPTFRSYLLPPPQTDDKINSEPKIKKLEPVLLPGEIVVNEVNFVRKCIATDTSQYDLWGKLICSNFKISFITDDPMPLQKFHYRNLLLGEHDVPLTCIEQIVTVNDHKRKQKVLGPNQKLKFNPTELIIYCKDFRIVRFRFDESGPESAKKVCLAIAHYSQPTDLQLLFAFEYVGKKYHNSANKINGIPSGDGGGGGGGGNGAGGGSSQKTPLFETYSDWDREIKRTGASGWRVCSINEGYMISTCLPEYIVVPSSLADQDLKIFSHSFVGRRMPLWCWSHSNGSALVRMALIKDVLQQRKIDQRICNAITKSHPQRSDVYKSDLDKTLPNIQEVQAAFVKLKQLCVNEPFEETEEKWLSSLENTRWLEYVRAFLKHSAELVYMLESKHLSVVLQEEEGRDLSCCVASLVQVMLDPYFRTITGFQSLIQKEWVMAGYQFLDRCNHLKRSEKESPLFLLFLDATWQLLEQYPAAFEFSETYLAVLYDSTRISLFGTFLFNSPHQRVKQSTEFAISKNIQLGDEKGLKFPSVWDWSLQFTAKDRTLFHNPFYIGKSTPCIQNGSVKSFKRTKVNHYLSLLKRREAIPADKGSHSAFLLMPRGCHPGPQALLGGIMNQLQPGLKGWASACEEAVCAQVQGECLCHRESKLSYCACREPCSPED

SEQ ID NO: 849598 - protein, 451 aa, Homo sapiens
MPLQKFHYRNLLLGEHDVPLTCIEQIVTVNDHKRKQKVLGPNQKLKFNPTELIIYCKDFRIVRFRFDESGPESAKKVCLAIAHYSQPTDLQLLFAFEYVGKKYHNSANKINGIPSGDGGGGGGGGNGAGGGSSQKTPLFETYSDWDREIKRTGASGWRVCSINEGYMISTCLPEYIVVPSSLADQDLKIFSHSFVGRRMPLWCWSHSNGSALVRMALIKDVLQQRKIDQRICNAITKSHPQRSDVYKSDLDKTLPNIQEVQAAFVKLKQLCVNEPFEETEEKWLSSLENTRWLEYVRAFLKHSAELVYMLESKHLSVVLQEEEGRDLSCCVASLVQVMLDPYFRTITGFQSLIQKEWVMAGYQFLDRCNHLKRSEKESPLFLLFLDATWQLLEQYPAAFEFSETYLAVLYDSTRISLFGTFLFNSPHQRVKQSTVSRIKSCTKQDYFPSRV

SEQ ID NO: 849599 - protein, 777 aa, Homo sapiens; identical to SEQ ID NO: 849593

SEQ ID NO: 849600 - protein, 777 aa, Homo sapiens; identical to SEQ ID NO: 849593

SEQ ID NO: 849601 - protein, 736 aa, Homo sapiens
GRRKGLGGRTESFTPGGVGAATGPRRERGEKAAAPCSPSSRPNPPSGPTSCHRPRLTIRSIRNRRLKNWSQSFCQKFHYRNLLLGEHDVPLTCIEQIVTVNDHKRKQKVLGPNQKLKFNPTELIIYCKDFRIVRFRFDESGPESAKKANKINGIPSGDGGGGGGGGNGAGGGSSQKTPLFETYSDWDREIKRTGASGWRVCSINEGYMISTCLPEYIVVPSSLADQDLKIFSHSFVGRRMPLWCWSHSNGSALVRMALIKDVLQQRKIDQRICNAITKSHPQRSDVYKSDLDKTLPNIQEVQAAFVKLKQLCVNEPFEETEEKWLSSLENTRWLEYVRAFLKHSAELVYMLESKHLSVVLQEEEGRDLSCCVASLVQVMLDPYFRTITGFQSLIQKEWVMAGYQFLDRCNHLKRSEKESPLFLLFLDATWQLLEQYPAAFEFSETYLAVLYDSTRISLFGTFLFNSPHQRVKQSTEFAISKNIQLGDEKGLKFPSVWDWSLQFTAKDRTLFHNPFYIGKSTPCIQNGSVKSFKRTKKSYSSTLRGMPSALKNGIISDQELLPRRNSLILKPKPDPAQQTDSQNSDTEQYFREWFSKPANLHGVILPRVSGTHIKLWKLCYFRWVPEAQISLGGSITAFHKLSLLADEVDVLSRMLRQQRSGPLEACYGELGQSRMYFNASGPHHTDTSGTPEFLSSSFPFSPVGNLCRRSILGTPLSKFLSGAKIWLSTETLANED

SEQ ID NO: 849602 - protein, 581 aa, Homo sapiens [sequence omitted]

SEQ ID NO: 849603 - protein, 86 aa, Homo sapiens
VMKRPVDREPSPLCQHFWRPLLPRPLPFPSLHLLARSGREELTAIRRGLGTLLQQPCKMPAVITILKNEKLRFNGGIDQPKVMELD

SEQ ID NO: 849604 - protein, 1198 aa, Homo sapiens
MDEETRHSLECIQANQIFPRKQLIREDENLQVPFLELHGESTEFVGRAEDAIIALSNYRLHIKFKESLVNVPLQLIESVECRDIFQLHLTCKDCKVIRCQFSTFEQCQEWLKRLNNAIRPPAKIEDLFSFAYHAWCMEVYASEKEQHGDLCRPGEHVTSRFKNEVERMGFDMNNAWRISNINEKYKLCGSYPQELIVPAWITDKELESVSSFRSWKRIPAVIYRHQSNGAVIARCGQPEVSWWGWRNADDEHLVQSVAKACASDSRSSGSKLSTRNTSRDFPNGGDLSDVEFDSSLSNASGAESLAIQPQKLLILDARSYAAAVANRAKGGGCECPEYYPNCEVVFMGMANIHSIRRSFQSLRLLCTQMPDPGNWLSALESTKWLHHLSVLLKSALLVVHAVDQDQRPVLVHCSDGWDRTPQIVALAKLLLDPYYRTIEGFQVLVEMEWLDFGHKFADRCGHGENSDDLNERCPVFLQWLDCVHQLQRQFPCSFEFNEAFLVKLVQHTYSCLFGTFLCNNAKERGEKHTQERTCSVWSLLRAGNKAFKNLLYSSQSEAVLYPVCHVRNLMLWSAVYLPCPSPTTPVDDSCAPYPAPGTSPDDPPLSRLPKTRSYDNLTTACDNTVPLASRRCSDPSLNEKWQEHRRSLELSSLAGPGEDPLSADSLGKPTRVPGGAELSVAAGVAEGQMENILQEATKEESGVEEPAHRAGIEIQEGKEDPLLEKESRRKTPEASAIGLHQDPELGDAALRSHLDMSWPLFSQGISEQQSGLSVLLSSLQVPPRGEDSLEVPVEQFRIEEIAEGREEAVLPIPVDAKVGYGTSQSCSLLPSQVPFETRGPNVDSSTDMLVEDKVKSVSGPQGHHRSCLVNSGKDRLPQTMEPSPSETSLVERPQVGSVVHRTSLGSTLSLTRSPCALPLAECKEGLVCNGAPETENRASEQPPGLSTLQMYPTPNGHCANGEAGRSKDSLSRQLSAMSCSSAHLHSRNLHHKWLHSHSGRPSATSSPDQPSRSHLDDDGMSVYTDTIQQRLRQIESGHQQEVETLKKQVQELKSRLESQYLTSSLHFNGDFGDEVTSIPDSESNLDQNCLSRCSTEIFSEASWEQVDKQDTEMTRWLPDHLAAHCYACDSAFWLASRKHHCRNCGNVFCSSCCNQKVPVPSQQLFEPSRVCKSCYSSLHPTSSSIDLELDKPIAATSN

SEQ ID NO: 849605 - protein, 1230 aa, Homo sapiens
CGCEKAAAAAEEQPDETSQRLRRCPAPALAGSLVGWRRGRLCRGGPRHVLLPDFLVKPPSRKSSWDKLHLDEETRHSLECIQANQIFPRKQLIREDENLQVPFLELHGESTEFVGRAEDAIIALSNYRLHIKFKESLVNVPLQLIESVECRDIFQLHLTCKDCKVIRCQFSTFEQCQEWLKRLNNAIRPPAKIEDLFSFAYHAWCMEVYASEKEQHGDLCRPGEHVTSRFKNEVERMGFDMNNAWRISNINEKYKLCGSYPQELIVPAWITDKELESVSSFRSWKRIPAVIYRHQSNGAVIARCGQPEVSWWGWRNADDEHLVQSVAKACASDSRSSGSKLSTRNTSRDFPNGGDLSDVEFDSSLSNASGAESLAIQPQKLLILDARSYAAAVANRAKGGGCECPEYYPNCEVVFMGMANIHSIRRSFQSLRLLCTQMPDPGNWLSALESTKWLHHLSVLLKSALLVVHAVDQDQRPVLVHCSDGWDRTPQIVALAKLLLDPYYRTIEGFQVLVEMEWLDFGHKFADRCGHGENSDDLNERCPVFLQWLDCVHQLQRQFPCSFEFNEAFLVKLVQHTYSCLFGTFLCNNAKERGEKHTQERTCSVWSLLRAGNKAFKNLLYSSQSEAVLYPVCHVRNLMLWSAVYLPCPSPTTPVDDSCAPYPAPGTSPDDPPLSRLPKTRSYDNLTTACDNTVPLASRRCSDPSLNEKWQEHRRSLELSSLAGPGEDPLSADSLGKPTRVPGGAELSVAAGVAEGQMENILQEATKEESGVEEPAHRAGIEIQEGKEDPLLEKESRRKTPEASAIGLHQDPELGDAALRSHLDMSWPLFSQGISEQQSGLSVLLSSLQVPPRGEDSLEVPVEQFRIEEIAEGREEAVLPIPVDAKVGYGTSQSCSLLPSQVPFETRGPNVDSSTDMLVEDKVKSVSGPQGHHRSCLVNSGKDRLPQTMEPSPSETSLVERPQVGSVVHRTSLGSTLSLTRSPCALPLAECKEGLVCNGAPETENRASEQPPGLSTLQMYPTPNGHCANGEAGRSKDSLSRQLSAMSCSSAHLHSRNLHHKWLHSHSGRPSATSSPDQPSRSHLDDDGMSVYTDTIQQRLRQIESGHQQEVETLKKQVQELKSRLESQYLTSSLHFNGDFGDEVMTRWLPDHLAAHCYACDSAFWLASRKHHCRNCGNVFCSSCCNQKVPVPSQQLFEPSRVCKSCYSSLHPTSSSIDLELDKPIAATSN

SEQ ID NO: 849606 - protein, 629 aa, Homo sapiens [sequence omitted]

SEQ ID NO: 849607 - protein, 442 aa, Homo sapiens
MEVYASEKEQHGDLCRPGEHVTSRFKNEVERMGFDMNNAWRISNINEKYKLCGSYPQELIVPAWITDKELESVSSFRSWKRIPAVIYRHQSNGAVIARCGQPEVSWWGWRNADDEHLVQSVAKACASDSRSSGSKLSTRNTSRDFPNGGDLSDVEFDSSLSNASGAESLAIQPQKLLILDARSYAAAVANRAKGGGCECPEYYPNCEVVFMGMANIHSIRRSFQSLRLLCTQMPDPGNWLSALESTKWLHHLSVLLKSALLVVHAVDQDQRPVLVHCSDGWDRTPQIVALAKLLLDPYYRTIEGFQVLVEMEWLDFGHKFADRCGHGENSDDLNERCPVFLQWLDCVHQLQRQFPCSFEFNEAFLVKLVQHTYSCLFGTFLCNNAKERGEKHTQERTCSVWSLLRAGNKAFKNLLYSSQSEAVCILQPFHCGQQKEFGVGYI

SEQ ID NO: 849608 - protein, 1198 aa, Homo sapiens; identical to SEQ ID NO: 849604

SEQ ID NO: 849609 - protein, 160 aa, Homo sapiens
MEVYASEKEQHGDLCRPGEHVTSRFKNEVERMGFDMNNAWRISNINEKYKLCGSYPQELIVPAWITDKELESVSSFRSWKRIPAVIYRHQSNGAVIARCGQPEVSWWGWRNADDEHLVQSVAKACASDSRSSGSKLSTRNTSRDFPNGGDLSDVEFDSSL

SEQ ID NO: 849610 - protein, 1025 aa, Homo sapiens
MEVYASEKEQHGDLCRPGEHVTSRFKNEVERMGFDMNNAWRISNINEKYKLCGSYPQELIVPAWITDKELESVSSFRSWKRIPAVIYRHQSNGAVIARCGQPEVSWWGWRNADDEHLVQSVAKACASDSRSSGSKLSTRNTSRDFPNGGDLSDVEFDSSLSNASGAESLAIQPQKLLILDARSYAAAVANRAKGGGCECPEYYPNCEVVFMGMANIHSIRRSFQSLRLLCTQMPDPGNWLSALESTKWLHHLSVLLKSALLVVHAVDQDQRPVLVHCSDGWDRTPQIVALAKLLLDPYYRTIEGFQVLVEMEWLDFGHKFADRCGHGENSDDLNERCPVFLQWLDCVHQLQRQFPCSFEFNEAFLVKLVQHTYSCLFGTFLCNNAKERGEKHTQERTCSVWSLLRAGNKAFKNLLYSSQSEAVLYPVCHVRNLMLWSAVYLPCPSPTTPVDDSCAPYPAPGTSPDDPPLSRLPKTRSYDNLTTACDNTVPLASRRCSDPSLNEKWQEHRRSLELSSLAGPGEDPLSADSLGKPTRVPGGAELSVAAGVAEGQMENILQEATKEESGVEEPAHRAGIEIQEGKEDPLLEKESRRKTPEASAIGLHQDPELGDAALRSHLDMSWPLFSQGISEQQSGLSVLLSSLQVPPRGEDSLEVPVEQFRIEEIAEGREEAVLPIPVDAKVGYGTSQSCSLLPSQVPFETRGPNVDSSTDMLVEDKVKSVSGPQGHHRSCLVNSGKDRLPQTMEPSPSETSLVERPQVGSVVHRTSLGSTLSLTRSPCALPLAECKEGLVCNGAPETENRASEQPPGLSTLQMYPTPNGHCANGEAGRSKDSLSRQLSAMSCSSAHLHSRNLHHKWLHSHSGRPSATSSPDQPSRSHLDDDGMSVYTDTIQQRLRQIESGHQQEVETLKKQVQELKSRLESQYLTSSLHFNGDFGDEVMTRWLPDHLAAHCYACDSAFWLASRKHHCRNCGNVFCSSCCNQKVPVPSQQLFEPSRVCKSCYSSLHPTSSSIDLELDKPIAATSN

SEQ ID NO: 849611 - protein, 1034 aa, Homo sapiens
MEVYASEKEQHGDLCRPGEHVTSRFKNEVERMGFDMNNAWRISNINEKYKLCGSYPQELIVPAWITDKELESVSSFRSWKRIPAVIYRHQSNGAVIARCGQPEVSWWGWRNADDEHLVQSVAKACASDSRSSGSKLSTRNTSRDFPNGGDLSDVEFDSSLSNASGAESLAIQPQKLLILDARSYAAAVANRAKGGGCECPEYYPNCEVVFMGMANIHSIRRSFQSLRLLCTQMPDPGNWLSALESTKWLHHLSVLLKSALLVVHAVDQDQRPVLVHCSDGWDRTPQIVALAKLLLDPYYRTIEGFQVLVEMEWLDFGHKFADRCGHGENSDDLNERCPVFLQWLDCVHQLQRQFPCSFEFNEAFLVKLVQHTYSCLFGTFLCNNAKERGEKHTQERTCSVWSLLRAGNKAFKNLLYSSQSEAVLYPVCHVRNLMLWSAVYLPCPSPTTPVDDSCAPYPAPGTSPDDPPLSRLPKTRSYDNLTTACDNTVPLASRRCSDPSLNEKWQEHRRSLELSSLAGPGEDPLSADSLGKPTRVPGGAELSVAAGVAEGQMENILQEATKEESGVEEPAHRAGIEIQEGKEDPLLEKESRRKTPEASAIGLHQDPELGDAALRSHLDMSWPLFSQGISEQQSGLSVLLSSLQVPPRGEDSLEVPVEQFRIEEIAEGREEAVLPIPVDAKVGYGTSQSCSLLPSQVPFETRGPNVDSSTDMLVEDKVKSVSGPQGHHRSCLVNSGKDRLPQTMEPSPSETSLVERPQVGSVVHRTSLGSTLSLTRSPCALPLAECKEGLVCNGAPETENRASEQPPGLSTLQMYPTPNGHCANGEAGRSKDSLSRQLSAMSCSSAHLHSRNLHHKWLHSHSGRPSATSSPDQPSRSHLDDDGMSVYTDTIQQRLRQIESGHQQEVETLKKQVQELKSRLESQYLTSSLHFNGDFGDEVMTRWLPDHLAAHCYACDSAFWLASRKHHCRDTDRVDQTWNCGNVFCSSCCNQKVPVPSQQLFEPSRVCKSCYSSLHPTSSSIDLELDKPIAATSN

SEQ ID NO: 849612 - protein, 442 aa, Homo sapiens; identical to SEQ ID NO: 849607

SEQ ID NO: 849613 - protein, 629 aa, Homo sapiens [sequence omitted]

SEQ ID NO: 849614 - protein, 376 aa, Homo sapiens
MEVYASEKEQHGDLCRPGEHVTSRFKNEVERMGFDMNNAWRISNINEKYKLCGSYPQELIVPAWITDKELESVSSFRSWKRIPAVIYRHQSNGAVIARCGQPEVSWWGWRNADDEHLVQSVAKACASDSRSSGSKLSTRNTSRDFPNGGDLSDVEFDSSLSNASGAESLAIQPQKLLILDARSYAAAVANRAKGGGCECPEYYPNCEVVFMGMANIHSIRRSFQSLRLLCTQMPDPGNWLSALESTKWLHHLSVLLKSALLVVHAVDQDQRPVLVHCSDGWDRTPQIVALAKLLLDPYYRTIEGFQVLVEMEWLDFGHKFADRCGHGENSDDLNERCPVFLQWLDCVHQLQRQFPCSFEFNEAFLVSFFILGTFSI

SEQ ID NO: 849615 - protein, 132 aa, Homo sapiens
MDWTLAMAQESGVWSEAGQLALHSYLEGLHTLASCAPAPSLSAPRLKSCIQCVESQLLVVIMSVCMLVCQLRNVCVCVHAHACMYLFPVPSGSGCHFRLSALSPATSVPQPEREMRCSWTPHCIWAAGPELV

SEQ ID NO: 849616 - protein, 355 aa, Homo sapiens
PSLAAEMAATAAEAVASGSGEPREEAGALGPAWDESQLRSYSFPTRPIPRLSQSDPRAEELIENEEPVVLTDTNLVYPALKWDLEYLQENIGNGDFSVYSASTHKFLYYDEKKMANFQNFKPRSNREEMKFHEFVEKLQDIQQRGGEERLYLQQTLNDTVGRKIVMDFLGFNWNWINKQQGKRGWGQLTSNLLLIGMEGNVTPAHYDEQQNFFAQIKGYKRCILFPPDQFECLYPYPVHHPCDRQSQVDFDNPDYERFPNFQNVVGYETVVGPGDVLYIPMYWWHHIESLLNGGITITVNFWYKGAPTPKRIEYPLKAHQKVAIMRNIEKMLGEALGNPQEVGPLLNTMIKGRYN

SEQ ID NO: 849617 - protein, 355 aa, Homo sapiens; identical to SEQ ID NO: 849616

SEQ ID NO: 849618 - protein, 355 aa, Homo sapiens; identical to SEQ ID NO: 849616

SEQ ID NO: 849619 - protein, 189 aa, Homo sapiens
RLGRGLVLNRPRQQGKRGWGQLTSNLLLIGMEGNVTPAHYDEQQNFFAQIKGYKRCILFPPDQFECLYPYPVHHPCDRQSQVDFDNPDYERFPNFQNVVGYETVVGPGDVLYIPMYWWHHIESLLNGGITITVNFWYKGAPTPKRIEYPLKAHQKVAIMRNIEKMLGEALGNPQEVGPLLNTMIKGRYN

SEQ ID NO: 849620 - protein, 355 aa, Homo sapiens; identical to SEQ ID NO: 849616

SEQ ID NO: 849621 - protein, 355 aa, Homo sapiens; identical to SEQ ID NO: 849616

SEQ ID NO: 849622 - protein, 355 aa, Homo sapiens; identical to SEQ ID NO: 849616

SEQ ID NO: 849623 - protein, 313 aa, Homo sapiens
AGLLPSLLGCEHTLSVSPHAIIREPVVLTDTNLVYPALKWDLEYLQENIGNGDFSVYSASTHKFLYYDEKKMANFQNFKPRSNREEMKFHEFVEKLQDIQQRGGEERLYLQQTLNDTVGRKIVMDFLGFNWNWINKQQGKRGWGQLTSNLLLIGMEGNVTPAHYDEQQNFFAQIKGYKRCILFPPDQFECLYPYPVHHPCDRQSQVDFDNPDYERFPNFQNVVGYETVVGPGDVLYIPMYWWHHIESLLNGGITITVNFWYKGAPTPKRIEYPLKAHQKVAIMRNIEKMLGEALGNPQEVGPLLNTMIKGRYN

SEQ ID NO: 849624 - protein, 74 aa, Homo sapiens [sequence omitted]

SEQ ID NO: 849625 - protein, 92 aa, Homo sapiens
VNLSHQKPLTPVTLHFSETFATQPLAPSRPNAGSTPRTGGGKALGTGEVLVAAQIGDLLFFRAQTAAAAVRFRAAGAGSGARPEPGQPGWVG

SEQ ID NO: 849626 - protein, 346 aa, Homo sapiens
MDLDLLDLNPRIIAAIKKAKLKSVKEVLHFSGPDLKRLTNLSSPEVWHLLRTASLHLRGSSILTALQLHQQKERFPTQHQRLSLGCPVLDALLRGGLPLDGITELAGRSSAGKTQLALQLCLAVQFPRQHGGLEAGAVYICTEDAFPHKRLQQLMAQQPRLRTDVPGELLQKLRFGSQIFIEHVADVDTLLECVNKKVPVLLSRGMARLVVIDSVAAPFRCEFDSQASAPRARHLQSLGATLRELSSAFQSPVLCINQVTEAMEEQGAAHGPLGFWDERVSPALGITWANQLLVRLLADRLREEEAALGCPARTLRVLSAPHLPPSSCSYTISAEGVRGTPGTQSH

SEQ ID NO: 849627 - protein, 194 aa, Homo sapiens
MTSFRAGQGRISFGSVVSSLEVAFLFDLPSVLGNLTSSLWPALPAVWSWFSAPPPCLGLRPALQGGFSPVPVRPAWATRPGHLPVPCSENPQAVGAREPSLVRGQETHPGAPASLPCPPHGVPGGVPQPAAPVVCSPRRACLPEQAEHGHTSDQRDRVQASAAFCVVQGKTFSKSTARPFLCWVTAKGARPHWR

SEQ ID NO: 849628 - protein, 346 aa, Homo sapiens; identical to SEQ ID NO: 849626

SEQ ID NO: 849629 - protein, 346 aa, Homo sapiens; identical to SEQ ID NO: 849626

SEQ ID NO: 849630 - protein, 188 aa, Homo sapiens
MDLDLLDLNPRIIAAIKKAKLKSVKEVLHFSGPDLKRLTNLSSPEVWHLLRTASLHLRGSSILTALQLHQQKERFPTQHQRLSLGCPVLDALLRGGLPLDGITELAGRSSAGKTQLALQLCLAVQFPRQHGGLEAGAVYICTEDAFPHKRLQQLMAQQPRLRTDVPGELLQKLRFGSQIFIEHVADVM

SEQ ID NO: 849631 - protein, 158 aa, Homo sapiens
ATKERGKVKTRLGSGPGVVLSWPLGRGDSQGWSLGCPTVTPWEPPASSLHMEAQLGLRLRPAPWAGASDPLSLGTVPTRVSPPAHRAVLTPPPLRPQWGCRQAAPPHPPLGPWLPGAPPRHTLCPTKLQCGTRWRKHIPPTSSVRVQESLGVGGLPCL

SEQ ID NO: 849632 - protein, 179 aa, Homo sapiens
MDLDLLDLNPRIIAAIKKAKLKSVKEVLHFSGPDLKRLTNLSSPEVWHLLRTASLHLRGSSILTALQLHQQKERFPTQHQRLSLGCPVLDALLRGGLPLDGITELAGRSSAGKTQLALQLCLAVQFPRQHGGLEAGAVYICTEDAFPHKRLRAGRQRGRRSWAAAGVRGEAGSRGGGGR

SEQ ID NO: 849633 - protein, 346 aa, Homo sapiens; identical to SEQ ID NO: 849626

SEQ ID NO: 849634 - protein, 346 aa, Homo sapiens; identical to SEQ ID NO: 849626

SEQ ID NO: 849635 - protein, 112 aa, Homo sapiens
IHRHLAIHPHLANHRHLAINRHSPPEVIAQLGCCRKTYRSVLGQPLACCGLLPVCGLHPGVERWAGHTPAPHSGERTEACAGLSVELPGQCLGCGRCLVLKGKYSRISVKAR

SEQ ID NO: 849636 - protein, 141 aa, Homo sapiens
MARLVVIDSVAAPFRCEFDSQASAPRARHLQSLGATLRELSSAFQSPVLCINQVTEAMEEQGAAHGPLGFWDERVSPALGITWANQLLVRLLADRLREEEAALGCPARTLRVLSAPHLPPSSCSYTISAEGVRGTPGTQSH

SEQ ID NO: 849637 - protein, 217 aa, Homo sapiens
RHSCFPGAVYICTEDAFPHKRLQQLMAQQPRLRTDVPGELLQKLRFGSQIFIEHVADVDTLLECVNKKVPVLLSRGMARLVVIDSVAAPFRCEFDSQASAPRARHLQSLGATLRELSSAFQSPVLCINQVTEAMEEQGAAHGPLGFWDERVSPALGITWANQLLVRLLADRLREEEAALGCPARTLRVLSAPHLPPSSCSYTISAEGVRGTPGTQSH

SEQ ID NO: 849638 - protein, 102 aa, Homo sapiens
LVGRTGFRACAVHHQVTEAWRSRAGDGPLGFWDERVSPALGITWANQLLVRLLADRLREEEAALGCPARTLRVLSAPHLPPSSCSYTISAEGVRGTPGTQSH

SEQ ID NO: 849639 - protein, 194 aa, Homo sapiens [sequence omitted]

SEQ ID NO: 849640 - protein, 109 aa, Homo sapiens
QHLPPVPQEAVFCCWLLGATDVWIPEHPANPRLTFPLFPESPGRHLREIKLQSARDASVKSAKNTRVIPKPQRGESGRALNCCRRMVLFLALSTGGKCGGFGGFFKCIS

SEQ ID NO: 849641 - protein, 568 aa, Homo sapiens
RSVAPLPNEVPKTCMVRVPCSPPASLHPGMGEGARRSSRTLRGFPSQTSPAGVRNLGAQVCSQLLMWQNMGKSFAAAKSSSHQLEAGRGRVGTDSTPLWEARPGGCCLGPSDSAPLPGSTGLLPPAPPASCLDLSWVSLLRLSRMQGARAPRDQGQSPGRMSALGRSSVILLTYVLAATELTCLFMQFSIVPYLSRKLGLDSIAFGYLQTTFGVLQLLGGPVFGRFADQRGARAALTLSFLAALALYLLLAAASSPALPGVYLLFASRLPGALMHTLPAAQMVITDLSAPEERPAALGRLGLCFGVGVILGSLLGGTLVSAYGIQCPAILAALATLLGAVLSFTCIPASTKGAKTDAQAPLPGGPRASVFDLKAIASLLRLPDVPRIFLVKVASNCPTGLFMVMFSIISMDFFQLEAAQAGYLMSFFGLLQMVTQGLVIGQLSSHFSEEVLLRASVLVFIVVGLAMAWMSSVFHFCLLVPGLVFSLCTLNVVTDSMLIKAVSTSDTGTMLGLCASVQPLLRTLGPTVGGLLYRSFGVPVFGHVQVAINTLVLLVLWRKPMPQRKDKVR

SEQ ID NO: 849642 - protein, 499 aa, Homo sapiens
CSGQKKRSLRFPLLNQFPGYLRPCFTWRKTVARPGGCCLGPSDSAPLPGSTGLLPPAPPASCLDLSWVSLLRLSRMQGARAPRDQGQSPGRMSALGRSSVILLTYVLAATELTCLFMQFSIVPYLSRKLGLDSIAFGYLQTTFGVLQLLGGPVFGRFADQRGARAALTLSFLAALALYLLLAAASSPALPGVYLLFASRLPGALMHTLPAAQMVITDLSAPEERPAALGRLGLCFGVGVILGSLLGGTLVSAYGIQCPAILAALATLLGAVLSFTCIPASTKGAKTDAQAPLPGGPRASVFDLKAIASLLRLPDVPRIFLVKVASNCPTGLFMVMFSIISMDFFQLEAAQAGYLMSFFGLLQMVTQGLVIGQLSSHFSEEVLLRASVLVFIVVGLAMAWMSSVFHFCLLVPGLVFSLCTLNVVTDSMLIKAVSTSDTGTMLGLCASVQPLLRTLGPTVGGLLYRSFGVPVFGHVQVAINTLVLLVLWRKPMPQRKDKVR

SEQ ID NO: 849643 - protein, 246 aa, Homo sapiens
AVEVTLERSPHRHPCPSPPLQRQARPGGCCLGPSDSAPLPGSTGLLPPAPPASCLDLSWVSLLRLSRMQGARAPRDQGQSPGRMSALGRSSVILLTYVLAATELTCLFMQFSIVPYLSRKLGLDSIAFGYLQTTFGVLQLLGGPVFGRFADQRGARAALTLSFLAALALYLLLAAASSPALPGVYLLFASRLPGALMHTLPAAQMVITDLSAPEERPAALGRLGLCFGVGVILGSLLGGTLVSAYG

SEQ ID NO: 849644 - protein, 491 aa, Homo sapiens
HVEVTLERSPHRHPCPSPPLQRQARPGGCCLGPSDSAPLPGSTGLLPPAPPASCLDLSWVSLLRLSRMQGARAPRDQGQSPGRMSALGRSSVILLTYVLAATELTCLFMQFSIVPYLSRKLGLDSIAFGYLQTTFGVLQLLGGPVFGRFADQRGARAALTLSFLAALALYLLLAAASSPALPGVYLLFASRLPGALMHTLPAAQMVITDLSAPEERPAALGRLGLCFGVGVILGSLLGGTLVSAYGIQCPAILAALATLLGAVLSFTCIPASTKGAKTDAQAPLPGGPRASVFDLKAIASLLRLPDVPRIFLVKVASNCPTGLFMVMFSIISMDFFQLEAAQAGYLMSFFGLLQMVTQGLVIGQLSSHFSEEVLLRASVLVFIVVGLAMAWMSSVFHFCLLVPGLVFSLCTLNVVTDSMLIKAVSTSDTGTMLGLCASVQPLLRTLGPTVGGLLYRSFGVPVFGHVQVAINTLVLLVLWRKPMPQRKDKVR

SEQ ID NO: 849645 - protein, 167 aa, Homo sapiens
MVMFSIISMDFFQLEAAQAGYLMSFFGLLQMVTQGLVIGQLSSHFSEEVLLRASVLVFIVVGLAMAWMSSVFHFCLLVPGLVFSLCTLNVVTDSMLIKAVSTSDTGTMLGLCASVQPLLRTLGPTVGGLLYRSFGVPVFGHVQVAINTLVLLVLWRKPMPQRKDKVR

SEQ ID NO: 849646 - protein, 491 aa, Homo sapiens; identical to SEQ ID NO: 849644

SEQ ID NO: 849647 - protein, 354 aa, Homo sapiens
HVEVTLERSPHRHPCPSPPLQRQARPGGCCLGPSDSAPLPGSTGLLPPAPPASCLDLSWVSLLRLSRMQGARAPRDQGQSPGRMSALGRSSVILLTYVLAATELTCLFMQFSIVPYLSRKLGLDSIAFGYLQTTFGVLQLLGGPVFGRFADQRGARAALTLSFLAALALYLLLAAASSPALPGVYLLFASRLPGALMHTLPAAQMVITDLSAPEERPAALGRLGLCFGVGVILGSLLGGTLVSAYGIQCPAILAALATLLGAVLSFTCIPASTKGAKTDAQAPLPGGPRASVFDLKAIASLLRLPDVPRIFLVKVASNCPTGWSQTPGLNQSSLFGLPKCWDCRRDFEGSYNRE

SEQ ID NO: 849648 - protein, 232 aa, Homo sapiens
SGRQGGPERQEGPDREGVRRGGPDREGGPRASVFDLKAIASLLRLPDVPRIFLVKVASNCPTGLFMVMFSIISMDFFQLEAAQAGYLMSFFGLLQMVTQGLVIGQLSSHFSEEVLLRASVLVFIVVGLAMAWMSSVFHFCLLVPGLVFSLCTLNVVTDSMLIKAVSTSDTGTMLGLCASVQPLLRTLGPTVGGLLYRSFGVPVFGHVQVAINTLVLLVLWRKPMPQRKDKVR

SEQ ID NO: 849649 - protein, 359 aa, Homo sapiens
AVEVTLERSPHRHPCPSPPLQRQARPGGCCLGPSDSAPLPGSTGLLPPAPPASCLDLSWVSLLRLSRMQGARAPRDQGQSPGRMSALGRSSVILLTYVLAATELTCLFMQFSIVPYLSRKLGLDSIAFGYLQTTFGVLQLLGGPVFGRFADQRGARAALTLSFLAALALYLLLAAASSPALPGVYLLFASRLPGALMHTLPGRAGGLESRWGRVGGSLRRTRDTSREVCVRAGSGPKGWTGVGGDVGRGLWRGGSGGERAPPRGFRRSAPPPRPQPPRWSSRTCRHPRSGPRPWAGWASASASESSSAPCWAGPWSPRTGEWWGPGRSLWVRTPAAGSAPPRLLLASVSSFARGARVAT

SEQ ID NO: 849650 - protein, 491 aa, Homo sapiens; identical to SEQ ID NO: 849644

SEQ ID NO: 849651 - protein, 216 aa, Homo sapiens
WLGRARCDRPRLSRMQGARAPRDQGQSPGRMSALGRSSVILLTYVLAATELTCLFMQFSIVPYLSRKLGLDSIAFGYLQTTFGVLQLLGGPVFGRFADQRGARAALTLSFLAALALYLLLAAASSPALPGVYLLFASRLPGALMHTLPAAQMVITDLSAPEERPAALGRLGLCFGVGVILGSLLGGTLVSAYGTGAQVSESPSQDMHTRLALWSLS

SEQ ID NO: 849652 - protein, 491 aa, Homo sapiens; identical to SEQ ID NO: 849644

SEQ ID NO: 849653 - protein, 565 aa, Homo sapiens
AVEVTLERSPHRHPCPSPPLQRQARPGGCCLGPSDSAPLPGSTGLLPPAPPASCLDLSWVSLLRLSRMQGARAPRDQGQSPGRMSALGRSSVILLTYVLAATELTCLFMQFSIVPYLSRKLGLDSIAFGYLQTTFGVLQLLGGPVFGRFADQRGARAALTLSFLAALALYLLLAAASSPALPGVYLLFASRLPGALMHTLPGRAGGLESRWGRVGGSLRRTRDTSREVCVRAGSGPKGWTGVGGDVGRGLWRGGSGGERAPPRGFRRSAPPPLSPAAQMVITDLSAPEERPAALGRLGLCFGVGVILGSLLGGTLVSAYGIQCPAILAALATLLGAVLSFTCIPASTKGAKTDAQAPLPGGPRASVFDLKAIASLLRLPDVPRIFLVKVASNCPTGLFMVMFSIISMDFFQLEAAQAGYLMSFFGLLQMVTQGLVIGQLSSHFSEEVLLRASVLVFIVVGLAMAWMSSVFHFCLLVPGLVFSLCTLNVVTDSMLIKAVSTSDTGTMLGLCASVQPLLRTLGPTVGGLLYRSFGVPVFGHVQVAINTLVLLVLWRKPMPQRKDKVR

SEQ ID NO: 849654 - protein, 285 aa, Homo sapiens; identical to SEQ ID NO: 790890

SEQ ID NO: 849655 - protein, 269 aa, Homo sapiens
HVEVTLERSPHRHPCPSPPLQRQARPGGCCLGPSDSAPLPGSTGLLPPAPPASCLDLSWVSLLRLSRMQGARAPRDQGQSPGRMSALGRSSVILLTYVLAATELTCLFMQFSIVPYLSRKLGLDSIAFGYLQTTFGVLQLLGGPVFGRFADQRGARAALTLSFLAALALYLLLAAASSPALPGVYLLFASRLPGALMHTLPAAQMVITDLSAPEERPAALGRLGLCFGVGVILGSLLGGTLVSAYGTGAQVSESPSQDMHTRLALWSLS

SEQ ID NO: 849656 - protein, 179 aa, Homo sapiens
LLCRGALATTGQSGGPQLWGLATVQTPLPRLPHTHFYPLCLALVTQGLVIGQLSSHFSEEVLLRASVLVFIVVGLAMAWMSSVFHFCLLVPGLVFSLCTLNVVTDSMLIKAVSTSDTGTMLGLCASVQPLLRTLGPTVGGLLYRSFGVPVFGHVQVAINTLVLLVLWRKPMPQRKDKVR

SEQ ID NO: 849657 - protein, 279 aa, Homo sapiens
MEAVVNLYQEVMKHADPRIQGYPLMGSPLLMTSILLTYVYFVLSLGPRIMANRKPFQLRGFMIVYNFSLVALSLYIVYEFLMSGWLSTYTWRCDPVDYSNSPEALRMVRVAWLFLFSKFIELMDTVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYHSYTKGKRLPRALQQNGAPGIAKVKAN

SEQ ID NO: 849658 - protein, 279 aa, Homo sapiens; identical to SEQ ID NO: 849657

SEQ ID NO: 849659 - protein, 279 aa, Homo sapiens; identical to SEQ ID NO: 849657

SEQ ID NO: 849660 - protein, 279 aa, Homo sapiens; identical to SEQ ID NO: 849657

SEQ ID NO: 849661 - protein, 279 aa, Homo sapiens; identical to SEQ ID NO: 849657

SEQ ID NO: 849662 - protein, 346 aa, Homo sapiens
MHDRETAGERMARACALERDILVIGPVSSTRAGHPACMSQSLGPPYRKLALRLGHEESVLDDDSDSHMRVIDSTHDFSTDSMDPRIQGYPLMGSPLLMTSILLTYVYFVLSLGPRIMANRKPFQLRGFMIVYNFSLVALSLYIVYEFLMSGWLSTYTWRCDPVDYSNSPEALRMVRVAWLFLFSKFIELMDTVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYHSYTKGKRLPRALQQNGAPGIAKVKAN

SEQ ID NO: 849663 - protein, 225 aa, Homo sapiens [sequence omitted]

SEQ ID NO: 849664 - protein, 198 aa, Homo sapiens
MSGWLSTYTWRCDPVDYSNSPEALRMVRVAWLFLFSKFIELMDTVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYHSYTKGKRLPRALQQNGAPGIAKVKAN

SEQ ID NO: 849665 - protein, 279 aa, Homo sapiens; identical to SEQ ID NO: 849657

SEQ ID NO: 849666 - protein, 252 aa, Homo sapiens
MEAVVNLYQEVMKHADPRIQGYPLMGSPLLMTSILLTYVYFVLSLGPRIMANRKPFQLRGFMIVYNFSLVALSLYIVYEMVRVAWLFLFSKFIELMDTVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYHSYTKGKRLPRALQQNGAPGIAKVKAN

SEQ ID NO: 849667 - protein, 144 aa, Homo sapiens
MEAVVNLYQEVMKHADPRIQGYPLMGSPLLMTSILLTYVYFVLSLGPRIMANRKPFQLRGFMIVYNFSLVALSLYIVYEFLMSGWLSTYTWRCDPVDYSNSPEALRMVRVAWLFLFSKFIELMDTVIFILRKKDGQEEWALSMP

SEQ ID NO: 849668 - protein, 261 aa, Homo sapiens
MEAVVNLYQEVMKHADPRIQGYPLMGSPLLMTSILLTYVYFVLSLGPRIMANRKPFQLRGFMIVYNFSLVALSLYIVYEFLMSGWLSTYTWRCDPVDYSNSPEALRMVRVAWLFLFSKFIELMDTVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYQEEWALSMP

SEQ ID NO: 849669 - protein, 104 aa, Homo sapiens
MEAVVNLYQEVMKHADPRIQGYPLMGSPLLMTSILLTYVYFVLSLGPRIMANRKPFQLRGFMIVYNFSLVALSLYIVYEFLMSGWLSTYTWRCDPVDYSLRTAP

SEQ ID NO: 849670 - protein, 54 aa, Homo sapiens
MSGWLSTYTWRCDPVDYSNSPEALRMVRVAWLFLFSKFIELMDTMFRYQLGSYQ

SEQ ID NO: 849671 - protein, 97 aa, Homo sapiens
PSGDRKSAQQMRKWQAGRLAPGTSLWPCSLRALRRCPPGPYGVLSQDGGCCELVPRGDEARRSPDPGLPSDGVPLANDLHSPDLRVLRSLTWASHHG

SEQ ID NO: 849672 - protein, 279 aa, Homo sapiens; identical to SEQ ID NO: 849657

SEQ ID NO: 849673 - protein, 301 aa, Homo sapiens
AGLGPDHGGPKEAGPPGESLARMEAVVNLYQEVMKHADPRIQGYPLMGSPLLMTSILLTYVYFVLSLGPRIMANRKPFQLRGFMIVYNFSLVALSLYIVYEFLMSGWLSTYTWRCDPVDYSNSPEALRMVRVAWLFLFSKFIELMDTVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYHSYTKGKRLPRALQQNGAPGIAKVKAN

SEQ ID NO: 849674 - protein, 225 aa, Homo sapiens [sequence omitted]

SEQ ID NO: 849675 - protein, 309 aa, Homo sapiens
MEAVVNLYQEVMKHADPRIQGYPLMGSPLLMTSILLTYVYFVLSLGPRIMANRKPFQLRGFMIVYNFSLVALSLYIVYERGSDPCPQLAKGRDGWEGRTLVVYIHIPSQFLMSGWLSTYTWRCDPVDYSNSPEALRMVRVAWLFLFSKFIELMDTVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYHSYTKGKRLPRALQQNGAPGIAKVKAN

SEQ ID NO: 849676 - protein, 279 aa, Homo sapiens; identical to SEQ ID NO: 849657

SEQ ID NO: 849677 - protein, 117 aa, Homo sapiens [sequence omitted]

SEQ ID NO: 849678 - protein, 385 aa, Homo sapiens
MEAVVNLYQEVMKHADPRIQGYPLMGSPLLMTSILLTYVYFVLSLGPRIMANRKPFQLRGFMIVYNFSLVALSLYIVYEFLMSGWLSTYTWRCDPVDYSNSPEALRMVRVAWLFLFSKFIELMDTVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYIELMDTVIFILRKKDGQVTFLHVFHHSVLPWSWWWGVKIGPMKNELFPCHDKLFRACHNVPCTTDLSGLCYCWPSLTFGGTNAMTAIQVIQFGPGPPLPLYGSGPVRCLLSLKPGEPGLWGPDLSRELGLPLP

SEQ ID NO: 849679 - protein, 97 aa, Homo sapiens; identical to SEQ ID NO: 849671

SEQ ID NO: 849680 - protein, 97 aa, Homo sapiens; identical to SEQ ID NO: 849671

SEQ ID NO: 849681 - protein, 743 aa, Homo sapiens
MEEEGLECPNSSSEKRYFPESLDSSDGDEEEVLACEDLELNPFDGLPYSSRYYKLLKEREDLPIWKEKYSFMENLLQNQIVIVSGDAKCGKSAQVPQWCAEYCLSIHYQHGGVICTQVHKQTVVQLALRVADEMDVNIGHEVGYVIPFENCCTNETILRYCTDDMLQREMMSNPFLGSYGVIILDDIHERSIATDVLLGLLKDVLLARPELKLIINSSPHLISKLNSYYGNVPVIEVKNKHPVEVVYLSEAQKDSFESILRLIFEIHHSGEKGDIVVFLACEQDIEKVCETVYQGSNLNPDLGELVVVPLYPKEKCSLFKPLDETEKRCQVYQRRVVLTTSSGEFLIWSNSVRFVIDVGVERRKVYNPRIRANSLVMQPISQSQAEIRKQILGSSSSGKFFCLYTEEFASKDMTPLKPAEMQEANLTSMVLFMKRIDIAGLGHCDFMNRPAPESLMQALEDLDYLAALDNDGNLSEFGIIMSEFPLDPQLSKSILASCEFDCVDEVLTIAAMVTAPNCFSHVPHGAEEAALTCWKTFLHPEGDHFTLISIYKAYQDTTLNSSSEYCVEKWCRDYFLNCSALRMADVIRAELLEIIKRIELPYAEPAFGSKENTLNIKKALLSGYFMQIARDVDGSGNYLMLTHKQVAQLHPLSGYSITKKMPEWVLFHKFSISENNYIRITSEISPELFMQLVPQYYFSNLPPSESKDILQQVVDHLSPVSTMNKEQQMCETCPETEQRCTLQ

SEQ ID NO: 849682 - protein, 743 aa, Homo sapiens; identical to SEQ ID NO: 849681

SEQ ID NO: 849683 - protein, 320 aa, Homo sapiens [sequence omitted]

SEQ ID NO: 849684 - protein, 662 aa, Homo sapiens
MEEEGLECPNSSSEKRYFPESLDSSDGDEEEVLACEDLELNPFDGLPYSSRYYKLLKEREDLPIWKEKYSFMENLLQNQIVIVSGDAKCGKSAQVPQWCAEYCLSIHYQHGGVICTQVHKQTVVQLALRVADEMDVNIGHEVGYVIPFENCCTNETILRYCTDDMLQREMMSNPFLGSYGVIILDDIHERSIATDVLLGLLKDVLLARPELKLIINSSPHLISKLNSYYGNVPVIEVKNKHPVEVVYLSEAQKDSFESILRLIFEIHHSGEKGDIVVFLACEQVYNPRIRANSLVMQPISQSQAEIRKQILGSSSSGKFFCLYTEEFASKDMTPLKPAEMQEANLTSMVLFMKRIDIAGLGHCDFMNRPAPESLMQALEDLDYLAALDNDGNLSEFGIIMSEFPLDPQLSKSILASCEFDCVDEVLTIAAMVTAPNCFSHVPHGAEEAALTCWKTFLHPEGDHFTLISIYKAYQDTTLNSSSEYCVEKWCRDYFLNCSALRMADVIRAELLEIIKRIELPYAEPAFGSKENTLNIKKALLSGYFMQIARDVDGSGNYLMLTHKQVAQLHPLSGYSITKKMPEWVLFHKFSISENNYIRITSEISPELFMQLVPQYYFSNLPPSESKDILQQVVDHLSPVSTMNKEQQMCETCPETEQRCTLQ

SEQ ID NO: 849685 - protein, 367 aa, Homo sapiens
MQPISQSQAEIRKQILGSSSSGKFFCLYTEEFASKDMTPLKPAEMQEANLTSMVLFMKRIDIAGLGHCDFMNRPAPESLMQALEDLDYLAALDNDGNLSEFGIIMSEFPLDPQLSKSILASCEFDCVDEVLTIAAMVTAPNCFSHVPHGAEEAALTCWKTFLHPEGDHFTLISIYKAYQDTTLNSSSEYCVEKWCRDYFLNCSALRMADVIRAELLEIIKRIELPYAEPAFGSKENTLNIKKALLSGYFMQIARDVDGSGNYLMLTHKQVAQLHPLSGYSITKKMPEWVLFHKFSISENNYIRITSEISPELFMQLVPQYYFSNLPPSESKDILQQVVDHLSPVSTMNKEQQMCETCPETEQRCTLQ

SEQ ID NO: 849686 - protein, 499 aa, Homo sapiens
MEEEGLECPNSSSEKRYFPESLDSSDGDEEEVLACEDLELNPFDGLPYSSRYYKLLKEREDLPIWKEKYSFMENLLQNQIVIVSGDAKCGKSAQVPQWCAEYCLSIHYQHGGVICTQVHKQTVVQLALRVADEMDVNIGHEVGYVIPFENCCTNETILRYCTDDMLQREMMSNPFLGSYGVIILDDIHERSIATDVLLGLLKDVLLARPELKLIINSSPHLISKLNSYYGNVPVIEVKNKHPVEVVYLSEAQKDSFESILRLIFEIHHSGEKGDIVVFLACEQDIEKVCETVYQGSNLNPDLGELVVVPLYPKEKCSLFKPLDETEKRCQVYQRRVVLTTSSGEFLIWSNSVRFVIDVGVERRKVYNPRIRANSLVMQPISQSQAEIRKQILGSSSSGKFFCLYTEEFASKDMTPLKPAEMQEANLTSMVLFMKRIDIAGLGHCDFMNRPGSLMLPCQPGIRLRFTFSCPFSVLSSHDAQQCTQAWRGRWFGLKHFPAR

SEQ ID NO: 849687 - protein, 226 aa, Homo sapiens
MEEEGLECPNSSSEKRYFPESLDSSDGDEEEVLACEDLELNPFDGLPYSSRYYKLLKEREDLPIWKEKYSFMENLLQNQIVIVSGDAKCGKSAQVPQWCAEYCLSIHYQHGGVICTQVHKQTVVQLALRVADEMDVNIGHEVGYVIPFENCCTNETILRYCTDDMLQREMMSNPFLGSYGVIILDDIHERSIATDVLLGLLKDVLLARPELKLIINSSPHLISKRP

SEQ ID NO: 849688 - protein, 743 aa, Homo sapiens; identical to SEQ ID NO: 849681

SEQ ID NO: 849689 - protein, 743 aa, Homo sapiens; identical to SEQ ID NO: 849681

SEQ ID NO: 849690 - protein, 320 aa, Homo sapiens [sequence omitted]

SEQ ID NO: 849691 - protein, 320 aa, Homo sapiens [sequence omitted]

SEQ ID NO: 849692 - protein, 145 aa, Homo sapiens
LMQKLELGRYNETHAIAKWLLEKQELGGGFRSTQTTVVALEALTRFREAVPFKGIQDLHVQIRAPKTALNVNWYIDHSNAYQQRSAKFLAQDDLEIASGNGRGTISILTMYHKSPESREDNCNLYHLNATLHSALEGKPGVATGG

SEQ ID NO: 849693 - protein, 404 aa, Homo sapiens
LMQKLELGRYNETHAIAKWLLEKQELGGGFRSTQTTVVALEALTRFREAVPFKGIQDLHVQIRAPKTALNVNWYIDHSNAYQQRSAKFLAQDDLEIASGNGRGTISILTMYHKSPESREDNCNLYHLNATLHSALEENKKGGETFRLRMETRFQNNGEATMTIMEVSLLTGFYPNQDDPSSLSDVERYAFQYKTKTSTSDSTVVLYLVQAEFLQAALVTIYDYYEPSRRCSTFYNLPTEQSSLRKICHKDICRCAEGQCPSLQKPSGQLRQEELQTTACEAGVDFVYKTKLESVEVSASNPYVYYNTQLEDIIKSGTDPATPLAMKKFVSHATCHDSLGLQEQESYLIMGQTSDLWRIKSDYSYVLGKETFLILWPADGDASKKELRDQLEEFLEYMRTHGCQS

SEQ ID NO: 849694 - protein, 216 aa, Homo sapiens
SLQLSHEKNTVLGFRVHRMLQAEFLQAALVTIYDYYEPSRRCSTFYNLPTEQSSLRKICHKDICRCAEGQCPSLQKPSGQLRQEELQTTACEAGVDFVYKTKLESVEVSASNPYVYYNTQLEDIIKSGTDPATPLAMKKFVSHATCHDSLGLQEQESYLIMGQTSDLWRIKSDYSYVLGKETFLILWPADGDASKKELRDQLEEFLEYMRTHGCQS

SEQ ID NO: 849695 - protein, 176 aa, Homo sapiens
DDGPQTTTDGVLVPNGTRRCSTFYNLPTEQSSLRKICHKDICRCAEGQCPSLQKPSGLYKTKLESVEVSASNPYVYYNTQLEDIIKSGTDPATPLAMKKFVSHATCHDSLGLQEQESYLIMGQTSDLWRIKSDYSYVLGKETFLILWPADGDASKKELRDQLEEFLEYMRTHGCQS

SEQ ID NO: 849696 - protein, 434 aa, Homo sapiens
MSIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENKSKFGANAILGVSLAVCKAGAAERELPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 849697 - protein, 398 aa, Homo sapiens
MSIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENKSKFGANAILGVSLAVCKAGAAERELPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQVSEAAW

SEQ ID NO: 849698 - protein, 434 aa, Homo sapiens; identical to SEQ ID NO: 849696

SEQ ID NO: 849699 - protein, 434 aa, Homo sapiens; identical to SEQ ID NO: 849696

SEQ ID NO: 849700 - protein, 434 aa, Homo sapiens; identical to SEQ ID NO: 849696

SEQ ID NO: 849701 - protein, 434 aa, Homo sapiens; identical to SEQ ID NO: 849696

SEQ ID NO: 849702 - protein, 434 aa, Homo sapiens; identical to SEQ ID NO: 849696

SEQ ID NO: 849703 - protein, 221 aa, Homo sapiens
DAWVDPRVRALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 849704 - protein, 389 aa, Homo sapiens
MSIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENKSKFGANAILGVSLAVCKAGAAERELPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDTGLTWGNDVSVFHVAVDPKMTGVGGLARMGRVIERALTSVPLCVLTEACVGPERRLCAWGSFPLYISPQP

SEQ ID NO: 849705 - protein, 434 aa, Homo sapiens; identical to SEQ ID NO: 849696

SEQ ID NO: 849706 - protein, 209 aa, Homo sapiens
MSIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENKSKFGANAILGVSLAVCKAGAAERELPLYRHIAQLAGNSDLILPVPAFNVINGGSHAGNKLAMQEFMILPVGAESFRDAMRLGAEVYPPRGIPPREQPGKGMPPNGE

SEQ ID NO: 849707 - protein, 434 aa, Homo sapiens; identical to SEQ ID NO: 849696

SEQ ID NO: 849708 - protein, 434 aa, Homo sapiens; identical to SEQ ID NO: 849696

SEQ ID NO: 849709 - protein, 353 aa, Homo sapiens
MVRGLVLIGRGLMLELDGTENKSKFGANAILGVSLAVCKAGAAERELPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 849710 - protein, 337 aa, Homo sapiens
MSIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENKCKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 849711 - protein, 233 aa, Homo sapiens
GRVGRPTRPCGFAPNILDNSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 849712 - protein, 284 aa, Homo sapiens
MFDKTRLPYVALDVLCVLLAGLPFAILTSRHTPFQRGVFCNDESIKYPYKEDTIPYALLGGIIIPFSIIVIILGETLSVYCNLLHSNSFIRNNYIATIYKAIGTFLFGAAASQSLTDIAKYSIGRLRPHFLDVCDPDWSKINCSDGYIEYYICRGNAERVKEGRLSFYSGHSSFSMYCMLFVALYLQARMKGDWARLLRPTLQFGLVAVSIYVGLSRVSDYKHHWSDVLTGLIQGALVAILVAVYVSDFFKERTSFKERKEEDSHTTLHETPTTGNHYPSNHQP

SEQ ID NO: 849713 - protein, 285 aa, Homo sapiens
MFDKTRLPYVALDVLCVLLASMPMAVLKLGQIYPFQRGFFCKDNSINYPYHDSTVTSTVLILVGVGLPISSIILGETLSVYCNLLHSNSFIRNNYIATIYKAIGTFLFGAAASQSLTDIAKYSIGRLRPHFLDVCDPDWSKINCSDGYIEYYICRGNAERVKEGRLSFYSGHSSFSMYCMLFVALYLQARMKGDWARLLRPTLQFGLVAVSIYVGLSRVSDYKHHWSDVLTGLIQGALVAILVAVYVSDFFKERTSFKERKEEDSHTTLHETPTTGNHYPSNHQP

SEQ ID NO: 849714 - protein, 284 aa, Homo sapiens; identical to SEQ ID NO: 849712

SEQ ID NO: 849715 - protein, 284 aa, Homo sapiens; identical to SEQ ID NO: 849712

SEQ ID NO: 849716 - protein, 110 aa, Homo sapiens
MFDKTRLPYVALDVLCVLLASMPMAVLKLGQIYPFQRGFFCKDNSINYPYHDSTVTSTVLILVGVGLPISSLDCLLQFLLQGIPPSNEEYSVMMSPSSTLTKKTPYLMRY

SEQ ID NO: 849717 - protein, 109 aa, Homo sapiens
MYCMLFVALYLQARMKGDWARLLRPTLQFGLVAVSIYVGLSRVSDYKHHWSDVLTGLIQGALVAILVAVYVSDFFKERTSFKERKEEDSHTTLHETPTTGNHYPSNHQP

SEQ ID NO: 849718 - protein, 284 aa, Homo sapiens; identical to SEQ ID NO: 849712

SEQ ID NO: 849719 - protein, 284 aa, Homo sapiens; identical to SEQ ID NO: 849712

SEQ ID NO: 849720 - protein, 284 aa, Homo sapiens; identical to SEQ ID NO: 849712

SEQ ID NO: 849721 - protein, 284 aa, Homo sapiens; identical to SEQ ID NO: 849712

SEQ ID NO: 849722 - protein, 221 aa, Homo sapiens
MCSACCWIILGETLSVYCNLLHSNSFIRNNYIATIYKAIGTFLFGAAASQSLTDIAKYSIGRLRPHFLDVCDPDWSKINCSDGYIEYYICRGNAERVKEGRLSFYSGHSSFSMYCMLFVALYLQARMKGDWARLLRPTLQFGLVAVSIYVGLSRVSDYKHHWSDVLTGLIQGALVAILVAVYVSDFFKERTSFKERKEEDSHTTLHETPTTGNHYPSNHQP

SEQ ID NO: 849723 - protein, 260 aa, Homo sapiens [sequence omitted]

SEQ ID NO: 849724 - protein, 437 aa, Homo sapiens
GRCLLFRNVRPRGRGQPCPCDSLRDPSSTYIRQLESKVRLLEGDKLLAQQAGSGEFRTLRKGFSPYHSESQLASLPPSYQDSLQNGPACPAPELPSPPSAGYSPAGQKPEAVVHAMKVLEVHENLDRQLQDSCEEDLSEKEKAIVREMCNVVWRKLGDAASSKPSIRQHLSGNQFKGPCRATLLWTWTGPAGGPQGEFQAPDTGRTSSPAPVFFLCGELYIGRCPPWPSCHGSDALAQAAISRLIHQQPGKTRRCDCSCSRAARTPHSSLWALGSMSKRLQAASEIQPGNCPGSSVLPGMEGPLIKPSTPRLPPTLDRDHHYLGLDAGGTTSCPNAVAWPQAPQALGPRHVDKATHHICGWLEAALGPSCDPQPWRSGCPHTWGSVLSHPMPAAPCFWRSSPSPPVSAMSPCHPVQAMPFLGSSCPMPEARPFSWFT

SEQ ID NO: 849725 - protein, 405 aa, Homo sapiens
GRCLLFRNVRPRGRGQPCPCDSLRDPSSTYIRQLESKVRLLEGDKLLAQQAGSGEFRTLRKGFSPYHSESQLASLPPSYQDSLQNVLEVHENLDRQLQDSCEEDLSEKEKAIVREMCNVVWRKLGDAASSKPSIRSTCLGTSSRGLCRATLLWTWTGPAGGPQGEFQAPDTGRTSSPAPVFFLCGELYIGRCPPWPSCHGSDALAQAAISRLIHQQPGKTRRCDCSCSRAARTPHSSLWALGSMSKRLQAASEIQPGNCPGSSVLPGMEGPLIKPSTPRLPPTLDRDHHYLGLDAGGTTSCPNAVAWPQAPQALGPRHVDKATHHICGWLEAALGPSCDPQPWRSGCPHTWGSVLSHPMPAAPCFWRSSPSPPVSAMSPCHPVQAMPFLGSSCPMPEARPFSWFT

SEQ ID NO: 849726 - protein, 405 aa, Homo sapiens; identical to SEQ ID NO: 849725

SEQ ID NO: 849727 - protein, 405 aa, Homo sapiens; identical to SEQ ID NO: 849725

SEQ ID NO: 849728 - protein, 405 aa, Homo sapiens; identical to SEQ ID NO: 849725

SEQ ID NO: 849729 - protein, 918 aa, Homo sapiens
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQAFCFFYGLQCKQTHPTNSTSGTTLSTDLECGKLIREERGIRKQSSVHTV

SEQ ID NO: 849730 - protein, 905 aa, Homo sapiens
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQCLSFNAIMEELGISLKNQKKIKKKSRTKGKSSFTSILTCHQRRTQRKETVA

SEQ ID NO: 849731 - protein, 905 aa, Homo sapiens; identical to SEQ ID NO: 849730

SEQ ID NO: 849732 - protein, 299 aa, Homo sapiens
MSRGPSSAVLPSALGSRKLGPRSLSCLSDLDGGVALEPRACRPPGSPGRAPPPTPAPSGCDPRLRPIILRRARSLPSSPERRQKAAGAPGAACRPGCSQKLRVRFADALGLELAQVKVFNAGDDPSVPLHVLSRLAINSDLCCSSQDLEFTLHCLVPDFPPPVEAADFGERLQRQLVCLERVTCSDLGISGTVRVCNVAFEKQVAVRYTFSGWRSTHEAVARWRGPAGPEGTEDVFTFGFPVPPFLLELGSRVHFAVRYQVAGAEYWDNNDHRDYSLTCRNHALHMPRGECEESWIHFI

SEQ ID NO: 849733 - protein, 299 aa, Homo sapiens; identical to SEQ ID NO: 849732

SEQ ID NO: 849734 - protein, 361 aa, Homo sapiens
MATLARLQARSSTVGNQYYFRNSVVDPFRKKENDAAVKIQSWFRGCQVRAYIRHLNRIVTIIQKWWRSFLGRKQYQLTVQVAYYTMMMNLYNAMAVRIQRRWRGYRVRKYLFNYYYLKEYLKVVSETNDAIRKALEEFAEMKEREEKKANLEREEKKRDYQARKMHYLLSTKQIPGIYNSPFRKEPDPWELQLQKAKPLTHRRPKVKQKDSTSLTDWLACTSARSFPRSEILPPINRKQCQGPFRDITEVLEQRYRPLEPTLRVAEPIDELKLAREELRREEWLQNVNDNMFLPFSSYHKNEKYIPSMHLSSKYGPISYKEQFRSENPKKWICDKDFQTVLPSFELFSKYGKLYSKAGQIV

SEQ ID NO: 849735 - protein, 361 aa, Homo sapiens; identical to SEQ ID NO: 849734

SEQ ID NO: 849736 - protein, 361 aa, Homo sapiens; identical to SEQ ID NO: 849734

SEQ ID NO: 849737 - protein, 361 aa, Homo sapiens; identical to SEQ ID NO: 849734

SEQ ID NO: 849738 - protein, 361 aa, Homo sapiens; identical to SEQ ID NO: 849734

SEQ ID NO: 849739 - protein, 361 aa, Homo sapiens; identical to SEQ ID NO: 849734

SEQ ID NO: 849740 - protein, 361 aa, Homo sapiens; identical to SEQ ID NO: 849734

SEQ ID NO: 849741 - protein, 361 aa, Homo sapiens; identical to SEQ ID NO: 849734

SEQ ID NO: 849742 - protein, 276 aa, Homo sapiens [sequence omitted]

SEQ ID NO: 849743 - protein, 361 aa, Homo sapiens; identical to SEQ ID NO: 849734

SEQ ID NO: 849744 - protein, 361 aa, Homo sapiens; identical to SEQ ID NO: 849734

SEQ ID NO: 849745 - protein, 361 aa, Homo sapiens; identical to SEQ ID NO: 849734

SEQ ID NO: 849746 - protein, 361 aa, Homo sapiens; identical to SEQ ID NO: 849734

SEQ ID NO: 849747 - protein, 200 aa, Homo sapiens
MILDRYEYQMSISIVMNSVEPSHKSTQRPPPPQGRQRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRWGGSLGSHNRVCVTNNH

SEQ ID NO: 849748 - protein, 216 aa, Homo sapiens
MILDRYEYQMSISIVMNSVEPSHKSTQRPPPPQGRQRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRILLGQNRDGIVFSTDDYFHHQDGYSKTVTGSRT

SEQ ID NO: 849749 - protein, 155 aa, Homo sapiens
MALCSALMTIFTIKMGTAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRILLGQNRDGIVFSTDDYFHHQDGYSKTVTGSRT

SEQ ID NO: 849750 - protein, 93 aa, Homo sapiens
MILDRYEYQMSISIVMNSVEPSHKSTQRPPPPQGRQRILLGQNRDGIVFSTDDYFHHQDGYRYNVNQLGDAHDWNQNRAKQLTIENIGYRSIR

SEQ ID NO: 849751 - protein, 583 aa, Homo sapiens
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRWGGSLGSHNRVCVTNNH

SEQ ID NO: 849752 - protein, 583 aa, Homo sapiens; identical to SEQ ID NO: 849751

SEQ ID NO: 849753 - protein, 583 aa, Homo sapiens; identical to SEQ ID NO: 849751

SEQ ID NO: 849754 - protein, 583 aa, Homo sapiens; identical to SEQ ID NO: 849751

SEQ ID NO: 849755 - protein, 564 aa, Homo sapiens
MSYGEIEGKFLGPREEHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRWGGSLGSHNRVCVTNNH

SEQ ID NO: 849756 - protein, 471 aa, Homo sapiens
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNREVCFGLSVPG

SEQ ID NO: 849757 - protein, 420 aa, Homo sapiens [sequence omitted]

SEQ ID NO: 849758 - protein, 567 aa, Homo sapiens
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQSD

SEQ ID NO: 849759 - protein, 471 aa, Homo sapiens; identical to SEQ ID NO: 849756

SEQ ID NO: 849760 - protein, 326 aa, Homo sapiens
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQSEKDAGKIIVWTSIMEQTGL

SEQ ID NO: 849761 - protein, 477 aa, Homo sapiens
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNRAKQAYRSGKDPSSYNR

SEQ ID NO: 849762 - protein, 567 aa, Homo sapiens; identical to SEQ ID NO: 849758

SEQ ID NO: 849763 - protein, 459 aa, Homo sapiens
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYSKTSYRSGKISSYNR

SEQ ID NO: 849764 - protein, 599 aa, Homo sapiens
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRILLGQNRDGIVFSTDDYFHHQDGYSKTVTGSRT

SEQ ID NO: 849765 - protein, 651 aa, Homo sapiens
MLDRYEYQMSISIVMNSVEPSHKSTQRPPPPQGRQRERVLKKTGHRLSKTKQKRNRKRNKKQNSQNRIMEENSLEFLSDLTPGDQDPSQSEEEDIEKTRRESEYPFIDGLQNEVGDFVTGYKEKRWKNKDPKDSFQNVMSIVELDNTPKNYLSKEGDNLFVSLLLRPNEISVTCPILTQNLSCVTTDDCSGMKVEKHIRNRHTIALDTQDLSAETSCLFMKKREIVDKNLSHEPILCHQHGIRMSDKVLREEQVYTTKINHWAFFTTNLSDEDLQLGSDRQPYFGSWPAGPHKFICEQRPKKDRACKLAGPDSRGQWIQMIFTSVAASEPGNNPEILTDKLLIGNEDFSPPPETMDSFIETNLFRSCLPQPDIPKNALESTKNKKRRKKRIFNLVPNFDLLGQSRIGVKEREKCDLLTKNHGLKITLGEEKDRISERNSEEENKQKLMTFDHHPLWFYLDIIKATPLNIDGQRYSHCLSFNRLRCSASLYKNYIPSFVLHNLSSIWKPSFTNKKLFLTFESQTRVGNKLNDAGFISPEILHSHPDTSCSLGVTSDFHFLNERFDRKLKRWEEPKELPAEDSQDLTSTDYRSLELPLSQGFAFQLVKLFGSPGVPMESLLPDDYVVPLDWKTLKMIYLQWKMSVEKRQKKIG

SEQ ID NO: 849766 - protein, 142 aa, Homo sapiens
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPESEGDQRRTPI

SEQ ID NO: 849767 - protein, 73 aa, Homo sapiens
LIHDILYLCIQASRWLLNVAVEAAGSGGACGWMPESTIRKLGCGRWKEVPDACLEQDSFFLPLDEGFLDLPGN

SEQ ID NO: 849768 - protein, 583 aa, Homo sapiens; identical to SEQ ID NO: 849751

SEQ ID NO: 849769 - protein, 583 aa, Homo sapiens; identical to SEQ ID NO: 849751

SEQ ID NO: 849770 - protein, 567 aa, Homo sapiens; identical to SEQ ID NO: 849758

SEQ ID NO: 849771 - protein, 565 aa, Homo sapiens
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEDLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRWGGSLGSHNRVCVTNNH

SEQ ID NO: 849772 - protein, 477 aa, Homo sapiens; identical to SEQ ID NO: 849761

SEQ ID NO: 849773 - protein, 402 aa, Homo sapiens
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGGLFWAKCPRIEYLARSQKT

SEQ ID NO: 849774 - protein, 410 aa, Homo sapiens
MRVLVDICSEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRWGGSLGSHNRVCVTNNH

SEQ ID NO: 849775 - protein, 1181 aa, Homo sapiens
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRERVLKKTGHRLSKTKQKRNRKRNKKQNSQNRIMEENSLEFLSDLTPGDQDPSQSEEEDIEKTRRESEYPFIDGLQNEVGDFVTGYKEKRWKNKDPKDSFQNVMSIVELDNTPKNYLSKEGDNLFVSLLLRPNEISVTCPILTQNLSCVTTDDCSGMKVEKHIRNRHTIALDTQDLSAETSCLFMKKREIVDKNLSHEPILCHQHGIRMSDKVLREEQVYTTKINHWAFFTTNLSDEDLQLGSDRQPYFGSWPAGPHKFICEQRPKKDRACKLAGPDSRGQWIQMIFTSVAASEPGNNPEILTDKLLIGNEDFSPPPETMDSFIETNLFRSCLPQPDIPKNALESTKNKKRRKKRIFNLVPNFDLLGQSRIGVKEREKCDLLTKNHGLKITLGEEKDRISERNSEEENKQKLMTFDHHPLWFYLDIIKATPLNIDGQRYSHCLSFNRLRCSASLYKNYIPSFVLHNLSSIWKPSFTNKKLFLTFESQTRVGNKLNDAGFISPEILHSHPDTSCSLGVTSDFHFLNERFDRKLKRWEEPKELPAEDSQDLTSTDYRSLELPLSQGFAFQLVKLFGSPGVPMESLLPDDYVVPLDWKTLKMIYLQWKMSVEKRQKKIG

SEQ ID NO: 849776 - protein, 139 aa, Homo sapiens
MALCSALMTIFTIKMGTAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRWGGSLGSHNRVCVTNNH

SEQ ID NO: 849777 - protein, 585 aa, Homo sapiens
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQSILIASVSSWKGFQDMNDVL

SEQ ID NO: 849778 - protein, 583 aa, Homo sapiens [sequence omitted]

SEQ ID NO: 849779 - protein, 635 aa, Homo sapiens
MNFITDIAPWTATRTFTGIRERVLKKTGHRLSKTKQKRNRKRNKKQNSQNRIMEENSLEFLSDLTPGDQDPSQSEEEDIEKTRRESEYPFIDGLQNEVGDFVTGYKEKRWKNKDPKDSFQNVMSIVELDNTPKNYLSKEGDNLFVSLLLRPNEISVTCPILTQNLSCVTTDDCSGMKVEKHIRNRHTIALDTQDLSAETSCLFMKKREIVDKNLSHEPILCHQHGIRMSDKVLREEQVYTTKINHWAFFTTNLSDEDLQLGSDRQPYFGSWPAGPHKFICEQRPKKDRACKLAGPDSRGQWIQMIFTSVAASEPGNNPEILTDKLLIGNEDFSPPPETMDSFIETNLFRSCLPQPDIPKNALESTKNKKRRKKRIFNLVPNFDLLGQSRIGVKEREKCDLLTKNHGLKITLGEEKDRISERNSEEENKQKLMTFDHHPLWFYLDIIKATPLNIDGQRYSHCLSFNRLRCSASLYKNYIPSFVLHNLSSIWKPSFTNKKLFLTFESQTRVGNKLNDAGFISPEILHSHPDTSCSLGVTSDFHFLNERFDRKLKRWEEPKELPAEDSQDLTSTDYRSLELPLSQGFAFQLVKLFGSPGVPMESLLPDDYVVPLDWKTLKMIYLQWKMSVEKRQKKIG

SEQ ID NO: 849780 - protein, 152 aa, Homo sapiens
MVHSPRSLVANPSQVLFFLSFLFFFFLRQSFALVAQAGVQWRNLGSLQPPPPGFKQFSCLSLLSSWDYRHAPPCPAYFVFLVDMGFPHVGQTGLELLTSGDPPASASQSAGITGGSHRAQPTSSNPYGIVFFFLPVKTFSGMSQEAGDCRET

SEQ ID NO: 849781 - protein, 134 aa, Homo sapiens
MRERSRARETGPESRAAVSARVGWRPTAPEPPPGTTQTPPPPCASLRPRRGPPDTSMDCCTENACSKPDDDILDIPLDDPGANAAAAKIQASFRGHMARKKIKSGERGRKGPGPGGPGGAGVARGGAGGGPSGD

SEQ ID NO: 849782 - protein, 81 aa, Homo sapiens
LGRDWVPGAGGGPSEDRPRTEHFQSSRGEMDAASPSQRRDFPAVFVTPSCPATCQLQEPPASQRLPHPGRLRRGVAESVPF

SEQ ID NO: 849783 - protein, 134 aa, Homo sapiens; identical to SEQ ID NO: 849781

SEQ ID NO: 849784 - protein, 134 aa, Homo sapiens; identical to SEQ ID NO: 849781

SEQ ID NO: 849785 - protein, 134 aa, Homo sapiens; identical to SEQ ID NO: 849781

SEQ ID NO: 849786 - protein, 134 aa, Homo sapiens; identical to SEQ ID NO: 849781

SEQ ID NO: 849787 - protein, 134 aa, Homo sapiens; identical to SEQ ID NO: 849781

SEQ ID NO: 849788 - protein, 68 aa, Homo sapiens
LHFSPPTLPEAAPDWLPGRGAQVTFASGAERGRPDPRAELLFRRGSAGGRRGGPGRRGRRPQRRLGQN

SEQ ID NO: 849789 - protein, 216 aa, Homo sapiens
ENPGLRLGPSELEVPSESRGTGGHSRSACCCFPCPSKPTLQSALQTPNSVLVMGLALPHPILPALLFPELRHDCPPGPEPSSPVAAHAPVSVPAIALLQARHPSLYLPPPRRHSPCPSGLYSYPTPADQDPVTPQEPPCFSPQENACSKPDDDILDIPLDDPGANAAAAKIQASFRGHMARKKIKSGERGRKGPGPGGPGGAGVARGGAGGGPSGD

SEQ ID NO: 849790 - protein, 140 aa, Homo sapiens
STSPRPPCRRLLLIGFPAAGLRLHSRAEPSAGDRTREQSCCFGAGRLAADCPRAPTRHHTDPTPALRQPSSPQRTPRHQHGLLHRERLLQAGRRHSRHPAGRSRRQRGRRQNPELSIFKVPEERWMPRPLRSDETSLPCL

SEQ ID NO: 849791 - protein, 134 aa, Homo sapiens; identical to SEQ ID NO: 849781

SEQ ID NO: 849792 - protein, 134 aa, Homo sapiens; identical to SEQ ID NO: 849781

SEQ ID NO: 849793 - protein, 134 aa, Homo sapiens; identical to SEQ ID NO: 849781

SEQ ID NO: 849794 - protein, 84 aa, Homo sapiens
SRIARQSVLQEIQHCVFLSRSLPFPQRTVEGSLSSSLVYANAERLGGSVGGVFHGPAPPLSVPPSPPPGSWGCGRKVSDLRVCM

SEQ ID NO: 849795 - protein, 869 aa, Homo sapiens
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTSVEECSQKGCLALSLLELLGFNLTFVFLASLLVLIEPVAAGSGIPEVKCYLNGVKVPGIVRLRTLLCKVLGVLFSVAGGLFVGKEGPMIHSGSVVGAGLPQFQSISLRKIQFNFPYFRSDRDKRDFVSAGAAAGVAAAFGAPIGGTLFSLEEGSSFWNQGLTWKVLFCSMSATFTLNFFRSGIQFGSWGSFQLPGLLNFGEFKCSDSDKKCHLWTAMDLGFFVVMGVIGGLLGATFNCLNKRLAKYRMRNVHPKPKLVRVLESLLVSLVTTVVVFVASMVLGECRQMSSSSQIGNDSFQLQVTEDVNSSIKTFFCPNDTYNDMATLFFNPQESAILQLFHQDGTFSPVTLALFFVLYFLLACWTYGISVPSGLFVPSLLCGAAFGRLVANVLKSYIGLGHIYSGTFALIGAAAFLGGVVRMTISLTVILIESTNEITYGLPIMVTLMVAKWTGDFFNKGIYDIHVGLRGVPLLEWETEVEMDKLRASDIMEPNLTYVYPHTRIQSLVSILRTTVHHAFPVVTENRGNEKEFMKGNQLISNNIKFKKSSILTRAGEQRKRSQSMKSYPSSELRNMCDEHIASEEPAEKEDLLQQMLERRYTPYPNLYPDQSPSEDWTMEERFRPLTFHGLILRSQLVTLLVRGVCYSESQSSASQPRLSYAEMAEDYPRYPDIHDLDLTLLNPRMIVDVTPYMNPSPFTVSPNTHVSQVFNLFRTMGLRHLPVVNAVGEIVGIITRHNLTYEFLQARLRQHYQTI

SEQ ID NO: 849796 - protein, 353 aa, Homo sapiens
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTSVEECSQKGCLALSLLELLGFNLTFVFLASLLVLIEPVAAGSGIPEVKCYLNGVKVPGIVRLRTLLCKVLGVLFSVAGGLFVGKEGPMIHSGSVVGAGLPQFQSISLRKIQFNFPYFRSDRDKRDFVSAGAAAGVAAAFGAPIGGTLFSLEEGSSFWNQGLTWKVLFCSMSATFTLNFFRSGIQFGSWGSFQLPGLLNFGEFKSLREPPCVSGNHRGGVCGLDGVRRMPTDVLFESNR

SEQ ID NO: 849797 - protein, 102 aa, Homo sapiens
RTWKADSKVLSEPQLLFHLPLPEGATAQRLSTHLMASVTMTVTLERKKYLCQGKEASLFPASSASSRRWVLCGCATLLHSSFSLLGGRDIFQRLSLRSGPMR

SEQ ID NO: 849798 - protein, 122 aa, Homo sapiens
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTYKFQMKM

SEQ ID NO: 849799 - protein, 813 aa, Homo sapiens
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTSVEECSQKGCLALSLLELLGFNLTFVFLASLLVLIEPVAAGSGIPEVKCYLNGVKVPGIVRLRTLLCKVLGVLFSVAGGLFVGKEGPMIHSGSVVGAGLPQFQSISLRKIQFNFPYFRSDRDKRDFVSAGAAAGVAAAFGAPIGGTLFSLEEGSSFWNQGLTWKVLFCSMSATFTLNFFRSGIQFGSWGSFQLPGLLNFGEFKVLESLLVSLVTTVVVFVASMVLGECRQMSSSSQIGNDSFQLQVTEDVNSSIKTFFCPNDTYNDMATLFFNPQESAILQLFHQDGTFSPVTLALFFVLYFLLACWTYGISVPSGLFVPSLLCGAAFGRLVANVLKSYIGLGHIYSGTFALIGAAAFLGGVVRMTISLTVILIESTNEITYGLPIMVTLMVAKWTGDFFNKGIYDIHVGLRGVPLLEWETEVEMDKLRASDIMEPNLTYVYPHTRIQSLVSILRTTVHHAFPVVTENRGNEKEFMKGNQLISNNIKFKKSSILTRAGEQRKRSQSMKSYPSSELRNMCDEHIASEEPAEKEDLLQQMLERRYTPYPNLYPDQSPSEDWTMEERFRPLTFHGLILRSQLVTLLVRGVCYSESQSSASQPRLSYAEMAEDYPRYPDIHDLDLTLLNPRMIVDVTPYMNPSPFTVSPNTHVSQVFNLFRTMGLRHLPVVNAVGEIVGIITRHNLTYEFLQARLRQHYQTI

SEQ ID NO: 849800 - protein, 432 aa, Homo sapiens [sequence omitted]

SEQ ID NO: 849801 - protein, 161 aa, Homo sapiens
MTRMQQRPQGTGASCSLSLGPALLVLPGCYLRYRKLLQPSPLWAPILSILPPKQLDLRRLRGAVSSALSLLFRRADRSEESQGPRPRAPPSLWAGLTSPVQGGTSGRGLRAAPASSFGSLSTCGGTTSSSKGIFSSKWSSKFLKSIRSALDTALYMGLALV

SEQ ID NO: 849802 - protein, 869 aa, Homo sapiens; identical to SEQ ID NO: 849795

SEQ ID NO: 849803 - protein, 869 aa, Homo sapiens; identical to SEQ ID NO: 849795

SEQ ID NO: 849804 - protein, 383 aa, Homo sapiens
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTSVEECSQKGCLALSLLELLGFNLTFVFLASLLVLIEPVAAGSGIPEVKCYLNGVKVPGIVRLRTLLCKVLGVLFSVAGGLFVGKEGPMIHSGSVVGAGLPQFQSISLRKIQFNFPYFRSDRDKRDFVSAGAAAGVAAAFGAPIGGTLFSLEEGSSFWNQGLTWKVLFCSMSATFTLNFFRSGIQFGSWGSFQLPGLLNFGEFKSPAHPLLVLPGEANHAHSGGHSWLGLFRGMEDSQLPTHSESRESSDTLLVRGPGGGFEPSELGLF

SEQ ID NO: 849805 - protein, 308 aa, Homo sapiens
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTSVEECSQKGCLALSLLELLGFNLTFVFLASLLVLIEPVAAGSGIPEVKCYLNGVKVPGIVRLRTLLCKVLGVLFSVAGGLFVGKEGPMIHSGSVVGAGLPQFQSISLRKIQFNFPYFRSDRSGCWSCCSFRGANRGYLVQSRGGFVLLEPRAHVESALLFHVCHLHPQLLPFWDSVWKLGFLPAPWIAELWRV

SEQ ID NO: 849806 - protein, 869 aa, Homo sapiens; identical to SEQ ID NO: 849795

SEQ ID NO: 849807 - protein, 585 aa, Homo sapiens
MSATFTLNFFRSGIQFGSWGSFQLPGLLNFGEFKCSDSDKKCHLWTAMDLGFFVVMGVIGGLLGATFNCLNKRLAKYRMRNVHPKPKLVRVLESLLVSLVTTVVVFVASMVLGECRQMSSSSQIGNDSFQLQVTEDVNSSIKTFFCPNDTYNDMATLFFNPQESAILQLFHQDGTFSPVTLALFFVLYFLLACWTYGISVPSGLFVPSLLCGAAFGRLVANVLKSYIGLGHIYSGTFALIGAAAFLGGVVRMTISLTVILIESTNEITYGLPIMVTLMVAKWTGDFFNKGIYDIHVGLRGVPLLEWETEVEMDKLRASDIMEPNLTYVYPHTRIQSLVSILRTTVHHAFPVVTENRGNEKEFMKGNQLISNNIKFKKSSILTRAGEQRKRSQSMKSYPSSELRNMCDEHIASEEPAEKEDLLQQMLERRYTPYPNLYPDQSPSEDWTMEERFRPLTFHGLILRSQLVTLLVRGVCYSESQSSASQPRLSYAEMAEDYPRYPDIHDLDLTLLNPRMIVDVTPYMNPSPFTVSPNTHVSQVFNLFRTMGLRHLPVVNAVGEIVGIITRHNLTYEFLQARLRQHYQTI

SEQ ID NO: 849808 - protein, 869 aa, Homo sapiens; identical to SEQ ID NO: 849795

SEQ ID NO: 849809 - protein, 869 aa, Homo sapiens; identical to SEQ ID NO: 849795

SEQ ID NO: 849810 - protein, 869 aa, Homo sapiens; identical to SEQ ID NO: 849795

SEQ ID NO: 849811 - protein, 91 aa, Homo sapiens
GVSKLGNYWARRSIHGTSVGGRARSRPGLPKLHPPFSSFSEAQEGLQKFKVVRAGVHAPEEVGPREAGEPPLPSAEPLPSVKDKMQIMEMI

SEQ ID NO: 849812 - protein, 180 aa, Homo sapiens
MAALDLRAELDSLVLQLLGDLEELEGKRTVLNARVEEGWLSLAKARYAMGAKSVGPLQYASHMEPQVCLHASEAQEGLQKFKVVRAGVHAPEEVGPREAGLRRRKGPTKTPEPESSEAPQDPLNWFGILVPHSLRQAQASFRDGLQLAADIASLQNRIDWGRSQLRGLQEKLKQLEPGAA

SEQ ID NO: 849813 - protein, 180 aa, Homo sapiens; identical to SEQ ID NO: 849812

SEQ ID NO: 849814 - protein, 172 aa, Homo sapiens
MAALDLRAELDSLVLQLLGDLEELEGKRTGWLSLAKARYAMGAKSVGPLQYASHMEPQVCLHASEAQEGLQKFKVVRAGVHAPEEVGPREAGLRRRKGPTKTPEPESSEAPQDPLNWFGILVPHSLRQAQASFRDGLQLAADIASLQNRIDWGRSQLRGLQEKLKQLEPGAA

SEQ ID NO: 849815 - protein, 193 aa, Homo sapiens
MAALDLRAELDSLVLQLLGDLEELEGKRTVLNARVEEGWLSLAKARYAMGAKSVGPLQYASHMEPQVCLHASEAQEGLQKFKVVRAGVHAPEEVGPREAGLRRRKGPTKTPEPESSEAPQDPLNWFGILVPHSLRQAQASFRDGVLEAKKRKCFLERVIQCVVSPAAEQEAEDESCPEDWAAAVPAETSAKAI

SEQ ID NO: 849816 - protein, 180 aa, Homo sapiens; identical to SEQ ID NO: 849812

SEQ ID NO: 849817 - protein, 126 aa, Homo sapiens
MGTPLDGGSRVPIGCPAKLRRVTRKKVAPDLEGWLSLAKARYAMGAKSVGPLQYASHMEPQVCLHASEAQEGLQKFKVVRAGVHAPEEVGPREAGLRRRKGPTKTPEPESSEAPQDPLNWFGILDI

SEQ ID NO: 849818 - protein, 180 aa, Homo sapiens; identical to SEQ ID NO: 849812

SEQ ID NO: 849819 - protein, 175 aa, Homo sapiens
MGTPLDGGSRVPIGCPAKLRRVTRKKVAPDLEGWLSLAKARYAMGAKSVGPLQYASHMEPQVCLHASEAQEGLQKFKVVRAGVHAPEEVGPREAGLRRRKGPTKTPEPESSEAPQDPLNWFGILVPHSLRQAQASFRDGLQLAADIASLQNRIDWGRSQLRGLQEKLKQLEPGAA

SEQ ID NO: 849820 - protein, 200 aa, Homo sapiens
MGTPLDGGSRVPIGCPAKLRRVTRKKVAPDLEGWLSLAKARYAMGAKSVGPLQYASHMEPQVCLHASEAQEGLQKFKVVRAGVHAPEEVGPREAGLRRRKGPTKTPEPESSEAPQDPLNWFGILVPHSLRQAQASFRDALLLNRRPKTRAARRTGQQLFQQRHQQKPSRGGSRVWTNREKKWRESRPAAGRRHSQPPEPH

SEQ ID NO: 849821 - protein, 188 aa, Homo sapiens
MGTPLDGGSRVPIGCPAKLRRVTRKKVAPDLEGWLSLAKARYAMGAKSVGPLQYASHMEPQVCLHASEAQEGLQKFKVVRAGVHAPEEVGPREAGLRRRKGPTKTPEPESSEAPQDPLNWFGILVPHSLRQAQASFRDGVLEAKKRKCFLERVIQCVVSPAAEQEAEDESCPEDWAAAVPAETSAKAI

SEQ ID NO: 849822 - protein, 131 aa, Homo sapiens
MAALDLRAELDSLVLQLLGDLEELEGKRTVLNARVEEGWLSLAKARYAMGAKSVGPLQYASHMEPQVCLHASEAQEGLQKFKVVRAGVHAPEEVGPREAGLRRRKGPTKTPEPESSEAPQDPLNWFGILDI

SEQ ID NO: 849823 - protein, 131 aa, Homo sapiens; identical to SEQ ID NO: 849822

SEQ ID NO: 849824 - protein, 153 aa, Homo sapiens
MAALDLRAELDSLVLQLLGDLEELEGKRTVLNARVEEGWLSLAKARYAMGAKSVGPLQYASHMEPQVCLHAREEASMLGWVGGRARSRPGLPKLHPPFSSFSEAQEGLQKFKVVRAGVHAPEEVGPREAGEPPLPSAEPLPSVKDKMQIMEMI

SEQ ID NO: 849825 - protein, 432 aa, Homo sapiens
RGPEAEPPPCRDFQTPTMASRWWRWRRGCSWKPAARSPGPGSPGRAGPLGPSAAAEVRAQVHRRKGLDLSQIPYINLVKHLTSACPNVCRISRFHHTTPDSKTHSGEKYTDPFKLGWRDLKGLYEDIRKELLISTSELKEMSEYYFDGKGKAFRPIIVALMARACNIHHNNSRHVQASQRAIALIAEMIHTASLVHDDVIDDASSRRGKHTVNKIWGEKKAVLAGDLILSAASIALARIGNTTVISILTQVIEDLVRGEFLQLGSKENENERFAHYLEKTFKKTASLIANSCKAVSVLGCPDPVVHEIAYQYGKNVGIAFQLIDDVLDFTSCSDQMGKPTSADLKLGLATGPVLFACQQFPEMNAMIMRRFSLPGDVDRARQYVLQSDGVQQTTYLAQQYCHEAIREISKLRPSPERDALIQLSEIVLTRDK

SEQ ID NO: 849826 - protein, 153 aa, Homo sapiens
MIFMDTPRNNCIQKQVSVLGCPDPVVHEIAYQYGKNVGIAFQLIDDVLDFTSCSDQMGKPTSADLKLGLATGPVLFACQQFPEMNAMIMRRFSLPGDVDRARQYVLQSDGVQQTTYLAQQYCHEAIREISKLRPSPERDALIQLSEIVLTRDK

SEQ ID NO: 849827 - protein, 397 aa, Homo sapiens
RGPEAEPPPCRDFQTPTMASRWWRWRRGCSWKPAARSPGPGSPGRAGPLGPSAAAEVRAQVHRRKGLDLSQIPYINLVKHLTSACPNVCRISRFHHTTPDSKTHSGEKYTDPFKLGWRDLKGLYEDIRKELLISTSELKEMSEYYFDGKGKAFRPIIVALMARACNIHHNNSRHVQASQRAIALIAEMIHTASLVHDDVIDDASSRRGKHTVNKIWGEKKAVLAGDLILSAASIALARIGNTTVISILTQVIEDLVRGEFLQLGSKENENERFAHYLEKTFKKTASLIANSCKAVSVLGCPDPVVHEIAYQYGKNVGIAFQLIDDVLDFTSCSDQMGKPTSADLKLGLATGPVLFACQQFPEMNAMIMRRFSLPGDVDRARQYVLQTTYEMFCFNWS

SEQ ID NO: 849828 - protein, 432 aa, Homo sapiens; identical to SEQ ID NO: 849825

SEQ ID NO: 849829 - protein, 460 aa, Homo sapiens
RGPEAEPPPCRDFQTPTMASRWWRWRRGCSWKPAARSPGPGSPGRAGPLGPSAAAEVRAQVHRRKGLDLSQIPYINLVKHLTSACPNVCRISRFHHTTPDSKTHSGEKYTDPFKLGWRDLKGLYEDIRKELLISTSELKEMSEYYFDGKGKAFRPIIVALMARACNIHHNNSRSDVQFSQADVLRRFQAASVKKHCFLLIRHVQASQRAIALIAEMIHTASLVHDDVIDDASSRRGKHTVNKIWGEKKAVLAGDLILSAASIALARIGNTTVISILTQVIEDLVRGEFLQLGSKENENERFAHYLEKTFKKTASLIANSCKAVSVLGCPDPVVHEIAYQYGKNVGIAFQLIDDVLDFTSCSDQMGKPTSADLKLGLATGPVLFACQQFPEMNAMIMRRFSLPGDVDRARQYVLQSDGVQQTTYLAQQYCHEAIREISKLRPSPERDALIQLSEIVLTRDK

SEQ ID NO: 849830 - protein, 397 aa, Homo sapiens; identical to SEQ ID NO: 849827

SEQ ID NO: 849831 - protein, 137 aa, Homo sapiens
YEFGRTRMATMRKRREQKRKQTSGKNVCMTNSRMRPWRVCKISSFSFSSLHRSISPGSLPCLSGSTFLCSCLLHLFLSAFSPHLLSSVHLIFLLPSCLCPSSSFQRLKTSQWPLAFQCLLLLLELPLPSSASVLPSS

SEQ ID NO: 849832 - protein, 95 aa, Homo sapiens
RPHWSAAFPLDYEFRENCGLNDHGDFVTPPFRKCSSGQCNPDGAELCSPCGGGAVTPTPAAGGGRTPWRCREVQMGLPAGQGRAGGGGPRCREPA

SEQ ID NO: 849833 - protein, 355 aa, Homo sapiens
MGPGRCLLTALLLLALAPPPEASQYCGRLEYWNPDNKCCSSCLQRFGPPPCPDYEFRENCGLNDHGDFVTPPFRKCSSGQCNPDGAELCSPCGGGAVTPTPAAGGGRTPWRCRERPVPAKGHCPLTPGNPGAPSSQERSSPASSIAWRTPEPVPQQAWPNFLPLVVLVLLLTLAVIAILLFILLWHLCWPKEKADPYPYPGLVCGVPNTHTPSSSHLSSPGALETGDTWKEASLLPLLSRELSSLASQPLSRLLDELEVLEELIVLLDPEPGPGGGMAHGTTRHLAARYGLPAAWSTFAYSLRPSRSPLRALIEMVVAREPSASLGQLGTHLAQLGRADALRVLSKLGSSGVCWA

SEQ ID NO: 849834 - protein, 355 aa, Homo sapiens; identical to SEQ ID NO: 849833

SEQ ID NO: 849835 - protein, 355 aa, Homo sapiens; identical to SEQ ID NO: 849833

SEQ ID NO: 849836 - protein, 355 aa, Homo sapiens; identical to SEQ ID NO: 849833

SEQ ID NO: 849837 - protein, 355 aa, Homo sapiens; identical to SEQ ID NO: 849833

SEQ ID NO: 849838 - protein, 355 aa, Homo sapiens; identical to SEQ ID NO: 849833

SEQ ID NO: 849839 - protein, 143 aa, Homo sapiens [sequence omitted]

SEQ ID NO: 849840 - protein, 143 aa, Homo sapiens [sequence omitted]

SEQ ID NO: 849841 - protein, 355 aa, Homo sapiens; identical to SEQ ID NO: 849833

SEQ ID NO: 849842 - protein, 167 aa, Homo sapiens
MGPGRCLLTALLLLALAPPPEASQYCGRLEYWNPDNKCCSSCLQRFGPPPCPELSSLASQPLSRLLDELEVLEELIVLLDPEPGPGGGMAHGTTRHLAARYGLPAAWSTFAYSLRPSRSPLRALIEMVVAREPSASLGQLGTHLAQLGRADALRVLSKLGSSGVCWA

SEQ ID NO: 849843 - protein, 143 aa, Homo sapiens [sequence omitted]

SEQ ID NO: 849844 - protein, 131 aa, Homo sapiens
MGPGRCLLTALLLLALAPPPEASQYCGRLEYWNPDNKCCSSCLQRFGPPPCPDYEFRENCGLNDHGDFVTPPFRKCSSGQCNPDGAELCSPCGGGAVTPTPAAGGGRTPWRCREAPWRQGTHGRRPHYFHS

SEQ ID NO: 849845 - protein, 187 aa, Homo sapiens
MGPGRCLLTALLLLALAPPPEASQYCGRLEYWNPDNKCCSSCLQRFGPPPCPGALETGDTWKEASLLPLLSRELSSLASQPLSRLLDELEVLEELIVLLDPEPGPGGGMAHGTTRHLAARYGLPAAWSTFAYSLRPSRSPLRALIEMVVAREPSASLGQLGTHLAQLGRADALRVLSKLGSSGVCWA

SEQ ID NO: 849846 - protein, 355 aa, Homo sapiens; identical to SEQ ID NO: 849833

SEQ ID NO: 849847 - protein, 136 aa, Homo sapiens
MGPGRCLLTALLLLALAPPPEASQYCGRLEYWNPDNKCCSSCLQRFGPPPCPDYEFRENCGLNDHGDFVTPPFRKCSSGQCNPDGAELCSPCGGGAVTPTPAAGGGRTPWRCRENCPVWRHNPCLASWMSWRCWKS

SEQ ID NO: 849848 - protein, 355 aa, Homo sapiens; identical to SEQ ID NO: 849833

SEQ ID NO: 849849 - protein, 137 aa, Homo sapiens
MGPGRCLLTALLLLALAPPPEASQYCGRLEYWNPDNKCCSSCLQRFGPPPCPDYEFRENCGLNDHGDFVTPPFRKCSSGQCNPDGAELCSPCGGGAVTPTPAAGGGRTPWRCREVQMGLPAGQGRAGGGGPRCREPA

SEQ ID NO: 849850 - protein, 143 aa, Homo sapiens [sequence omitted]

SEQ ID NO: 849851 - protein, 355 aa, Homo sapiens; identical to SEQ ID NO: 849833

SEQ ID NO: 849852 - protein, 355 aa, Homo sapiens; identical to SEQ ID NO: 849833

SEQ ID NO: 849853 - protein, 355 aa, Homo sapiens; identical to SEQ ID NO: 849833

SEQ ID NO: 849854 - protein, 154 aa, Homo sapiens
MESGPWLNSVTAGSTGRLCTGMYPRWLLQLHASAAHFPEPPEAALWAGTQAQAGVQRRSLGSVQPLPPREMGFHHVGQPGLELRTSGHPRGSILATIPERGTIGVPLITGMAASEALAPLPFTPNRDRCSWQDLSSKPPSLSCPILPRLPGSIM

SEQ ID NO: 849855 - protein, 150 aa, Homo sapiens
MNVCDNLGDHLVGNVYVKFRREEDGERAVAELSNRWFNGQAVHGNVPEVASATSCICGPFPRTSRGSSMGGDPGAGWSAKAQSWLSATSASQEMGFHHVGQPGLELRTSGNPPISASQSVGITGVNHCARSFPRLLYPKSSSELHLETST

SEQ ID NO: 849856 - protein, 313 aa, Homo sapiens
RPHWSAAFPLDYEFRENCGLNDHGDFVTPPFRKCSSGQCNPDGAELCSPCGGGAVTPTPAAGGGRTPWRCRERPVPAKGHCPLTPGNPGAPSSQERSSPASSIAWRTPEPVPQQAWPNFLPLVVLVLLLTLAVIAILLFILLWHLCWPKEKADPYPYPGLVCGVPNTHTPSSSHLSSPGALETGDTWKEASLLPLLSRELSSLASQPLSRLLDELEVLEELIVLLDPEPGPGGGMAHGTTRHLAARYGLPAAWSTFAYSLRPSRSPLRALIEMVVAREPSASLGQLGTHLAQLGRADALRVLSKLGSSGVCWA

SEQ ID NO: 849857 - protein, 355 aa, Homo sapiens; identical to SEQ ID NO: 849833

SEQ ID NO: 849858 - protein, 355 aa, Homo sapiens; identical to SEQ ID NO: 849833

SEQ ID NO: 849859 - protein, 355 aa, Homo sapiens; identical to SEQ ID NO: 849833

SEQ ID NO: 849860 - protein, 355 aa, Homo sapiens; identical to SEQ ID NO: 849833

SEQ ID NO: 849861 - protein, 355 aa, Homo sapiens; identical to SEQ ID NO: 849833

SEQ ID NO: 849862 - protein, 136 aa, Homo sapiens; identical to SEQ ID NO: 849847

SEQ ID NO: 849863 - protein, 355 aa, Homo sapiens; identical to SEQ ID NO: 849833

SEQ ID NO: 849864 - protein, 187 aa, Homo sapiens; identical to SEQ ID NO: 849845

SEQ ID NO: 849865 - protein, 167 aa, Homo sapiens; identical to SEQ ID NO: 849842

SEQ ID NO: 849866 - protein, 136 aa, Homo sapiens; identical to SEQ ID NO: 849847

SEQ ID NO: 849867 - protein, 355 aa, Homo sapiens; identical to SEQ ID NO: 849833

SEQ ID NO: 849868 - protein, 355 aa, Homo sapiens; identical to SEQ ID NO: 849833

SEQ ID NO: 849869 - protein, 355 aa, Homo sapiens; identical to SEQ ID NO: 849833

SEQ ID NO: 849870 - protein, 167 aa, Homo sapiens; identical to SEQ ID NO: 849842

SEQ ID NO: 849871 - protein, 103 aa, Homo sapiens
MNVCDNLGDHLVGNVYVKFRREEDGERAVAELSNRWFNGQAVHGNVPEVASATSCICGPFPRTSRGSSMGGDPGAGWSAKAQSWLSATSASQVQAILLSQPPK

SEQ ID NO: 849872 - protein, 77 aa, Homo sapiens
KSSQTWRAWVKMAEYLASIFGTEKDKVNCSFYFKIGVCRHGDRCSRLHNKPTFSQTIVLLNLYRNPQNTAQTADGSH

SEQ ID NO: 849873 - protein, 205 aa, Homo sapiens
MAHGPGALMLKCVVVGDGAVGKTCLLMSYANDAFPEEYVPTVFDHYAVSVTVGGKQYLLGLYDTAGQEDYDRLRPLSYPMTDVFLICFSVVNPASFQNVKEEWVPELKEYAPNVPFLLIGTQIDLRDDPKTLARLNDMKEKPICVEQGQKLAKEIGACCYVECSALTQKGLKTVFDEAIIAILTPKKHTVKKRIGSRCINCCLIT

SEQ ID NO: 849874 - protein, 205 aa, Homo sapiens; identical to SEQ ID NO: 849873

SEQ ID NO: 849875 - protein, 157 aa, Homo sapiens
MPTTPSRRSTCPPSSTTTQEDYDRLRPLSYPMTDVFLICFSVVNPASFQNVKEEWVPELKEYAPNVPFLLIGTQIDLRDDPKTLARLNDMKEKPICVEQGQKLAKEIGACCYVECSALTQKGLKTVFDEAIIAILTPKKHTVKKRIGSRCINCCLIT

SEQ ID NO: 849876 - protein, 205 aa, Homo sapiens; identical to SEQ ID NO: 849873

SEQ ID NO: 849877 - protein, 205 aa, Homo sapiens; identical to SEQ ID NO: 849873

SEQ ID NO: 849878 - protein, 205 aa, Homo sapiens; identical to SEQ ID NO: 849873

SEQ ID NO: 849879 - protein, 205 aa, Homo sapiens; identical to SEQ ID NO: 849873

SEQ ID NO: 849880 - protein, 205 aa, Homo sapiens; identical to SEQ ID NO: 849873

SEQ ID NO: 849881 - protein, 205 aa, Homo sapiens; identical to SEQ ID NO: 849873

SEQ ID NO: 849882 - protein, 131 aa, Homo sapiens
MAHGPGALMLKCVVVGDGAVGKTCLLMSYANDAFPEEYVPTVFDHYAVSVTVGGKQYLLGLYDTAGQEDYDRLRPLSYPMTDVFLICFSVVNPASFQNVKEEWVPELKEYAPNVPFLLIGTQMDLRDDPKT

SEQ ID NO: 849883 - protein, 119 aa, Homo sapiens [sequence omitted]

SEQ ID NO: 849884 - protein, 126 aa, Homo sapiens
MTDVFLICFSVVNPASFQNVKEEWVPELKEYAPNVPFLLIGTQIDLRDDPKTLARLNDMKEKPICVEQGQKLAKEIGACCYVECSALTQKGLKTVFDEAIIAILTPKKHTVKKRIGSRCINCCLIT

SEQ ID NO: 849885 - protein, 118 aa, Homo sapiens
MAHGPGALMLKCVVVGDGAVGKTCLLMSYANDAFPEEYVPTVFDHYAVSVTVGGKQYLLGLYDTAGQIGACCYVECSALTQKGLKTVFDEAIIAILTPKKHTVKKRIGSRCINCCLIT

SEQ ID NO: 849886 - protein, 205 aa, Homo sapiens; identical to SEQ ID NO: 849873

SEQ ID NO: 849887 - protein, 167 aa, Homo sapiens
MPTTPSRRSTCPPSSTTTQEDYDRLRPLSYPMTDVFLICFSVVNPASFQNVKEEWVPELKEYAPNVPFLLIGTQIDLRDDPKTLARLNDMKEKPICVEQGQKLAKEIGACCYVECSALTQKGLKTVFDEAIIAILTPKKHNLQWPRKLSISLRKQMKCYSYTQTFYR

SEQ ID NO: 849888 - protein, 205 aa, Homo sapiens; identical to SEQ ID NO: 849873

SEQ ID NO: 849889 - protein, 150 aa, Homo sapiens
MPTTPSRRSTCPPSSTTTQEDYDRLRPLSYPMTDVFLICFSVVNPASFQNVKEEWVPELKEYAPNVPFLLIGTQIDLRDDPKTLARLNDMKEKPICVEQGQKLAKEVMEHSQNLSMNVKDAKITIEANFIVYLLCARWSALHALSHLILA

SEQ ID NO: 849890 - protein, 110 aa, Homo sapiens
GCSMRIPSVYIVLCVGLEICVSRSQYSGPPALSMAPGARPRTRGVVVEPHELGVVHVAHCDEAGLPACGTMAVKKYLMEWEPAQVSVRATAPQSSRRRVRGTCNPSSPGG

SEQ ID NO: 849891 - protein, 655 aa, Homo sapiens
VISPPCAPTRNSHPGPGCTASPPAPPGWPFSQRGPGRWSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQAH

SEQ ID NO: 849892 - protein, 698 aa, Homo sapiens
VISPPCAPTRNSHPGPGCTASPPAPPGWPFSQRGPGRWSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGLGPSLLSPYSDEDTTQPGGPFQPRAGSAQAD

SEQ ID NO: 849893 - protein, 641 aa, Homo sapiens
GLRSGDWRAMALGLQRARSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLVCWGINGILWPSLPSWLKPTVL

SEQ ID NO: 849894 - protein, 294 aa, Homo sapiens
SSHRRAHPLVTRTRVLAAPHPLLHPLDGPSANGGLGDGRPRSCARKSPGMRPAAGAARRPRCCTSWLTRCPSPAASAPTWTRPLSCASPSATCACTASAPQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLEKGAKAVNKGIIAFPWAREG

SEQ ID NO: 849895 - protein, 232 aa, Homo sapiens
VISPPCAPTRNSHPGPGCTASPPAPPGWPFSQRGPGRWSTTELRKEKSRDAARSRRSQETEVLYQLAHTLPFARGVSAHLDKASIMRLTISYLRMHRLCAAEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEGFVMVLTAEGDMAYLSENVSNHLGLSQAGAHWTQHL

SEQ ID NO: 849896 - protein, 123 aa, Homo sapiens
SAYCSLRALGSSDSPASTSQIAGTTGMCHIARLIFVFLVEMGFHHVVQSGLELLTSSAPPASAFQSAGITGVSHCTRLELTFSKSLCFEFHRLQLFLVLGLTSLSFCLFSNLTIPKNCLVLGL

SEQ ID NO: 849897 - protein, 123 aa, Homo sapiens; identical to SEQ ID NO: 849896

SEQ ID NO: 849898 - protein, 301 aa, Homo sapiens
SQGPSLTPTSLSALYPSQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQAH

SEQ ID NO: 849899 - protein, 703 aa, Homo sapiens
VISPPCAPTRNSHPGPGCTASPPAPPGWPFSQRGPGRWSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQMRKLKLRLLTTGTELRSDGAGTSAKVHPSPRLILLPPSCPPQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLVCWGINGILWPSLPSWLKPTVL

SEQ ID NO: 849900 - protein, 331 aa, Homo sapiens
VISPPCAPTRNSHPGPGCTASPPAPPGWPFSQRGPGRWSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDSSSSPLHPFSSLVLVPCCCCNILPRTQWLQTTQTHCLTVLEVRNLK

SEQ ID NO: 849901 - protein, 466 aa, Homo sapiens
SSHRRAHPLVTRTRVLAAPHPLLHPLDGPSANGGLGDGRPRSCARKSPGMRPAAGAARRPRCCTSWLTRCPSPAASAPTWTRPLSCASPSATCACTASAPQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQTPAPHS

SEQ ID NO: 849902 - protein, 99 aa, Homo sapiens
HCLPTSTPAPCSPSPKELSPSLPPHTQSPDISLPICPLGGPDPSRSPSSVLSKGQAVTGQYRFLARSGGYLWTQTQATVVSGGRGPQSESIVCVHFLIR

SEQ ID NO: 849903 - protein, 123 aa, Homo sapiens; identical to SEQ ID NO: 849896

SEQ ID NO: 849904 - protein, 635 aa, Homo sapiens
RHREERGARGTMDWQDHRSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQAH

SEQ ID NO: 849905 - protein, 346 aa, Homo sapiens
VISPPCAPTRNSHPGPGCTASPPAPPGWPFSQRGPGRWSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTCMYPISPGAKPAATWPPADTRTPQL

SEQ ID NO: 849906 - protein, 290 aa, Homo sapiens [sequence omitted]

SEQ ID NO: 849907 - protein, 154 aa, Homo sapiens
MRNKEKTSLAAMPRKEKHIEPEVPRTSRDDSLNPGVQGRQPLTEGPRVIFIKPYRNRTPMGHMKQLDVADQWIWFEGLPTRIHLPAPRVMCRSSTLRWVKRRCTRFCSASLEMPMWHPYKVDVTWTRARGASRGWRSRHQLKGRNGWRNSRVYK

SEQ ID NO: 849908 - protein, 129 aa, Homo sapiens [sequence omitted]

SEQ ID NO: 849909 - protein, 527 aa, Homo sapiens
MSLPRCWFRYPGWTGAEAGRGRAIVSRRLPSLNPWDAGERHGGLVRICASLGPHKRLPAGLPQCPHLYLAADPLDPQRRQEKSCAALGNDKRRQPDGQRQPQQQQQPHCRRGFQAPALPNPLRVLQGLGRVSMSLGWLERPPALSRAAGDGARRLSGSRRGDVWLTSSAAGLLRSVAGGSWCGGQLRARGGSGRCVARAMTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKAKEKQNAKKAQETK

SEQ ID NO: 849910 - protein, 527 aa, Homo sapiens; identical to SEQ ID NO: 849909

SEQ ID NO: 849911 - protein, 554 aa, Homo sapiens
MSLPRCWFRYPGWTGAEAGRGRAIVSRRLPSLNPWDAGERHGGLVRICASLGPHKRLPAGLPQCPHLYLAADPLDPQRRQEKSCAALGNDKRRQPDGQRQPQQQQQPHCRRGFQAPALPNPLRVLQGLGRVSMSLGWLERPPALSRAAGDGARRLSGSRRGDVWLTSSAAGLLRSVAGGSWCGGQLRARGGSGRCVARAMTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKDGFSPCCPGWSQTPELKPSACLDLPKWYSEGEIRFNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKAKEKQNAKKAQETK

SEQ ID NO: 849912 - protein, 515 aa, Homo sapiens
MSLPRCWFRYPGWTGAEAGRGRAIVSRRLPSLNPWDAGERHGGLVRICASLGPHKRLPAGLPQCPHLYLAADPLDPQRRQEKSCAALGNDKRRQPDGQRQPQQQQQPHCRRGFQAPALPNPLRVLQGLGRVSMSLGWLERPPALSRAAGDGARRLSGSRRGDVWLTSSAAGLLRSVAGGSWCGGQLRARGGSGRCVARAMTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKGK

SEQ ID NO: 849913 - protein, 266 aa, Homo sapiens
MVRPGLARMSLPRCWFRYPGWTGAEAGRGRAIVSRRLPSLNPWDAGERHGGLVRICASLGPHKRLPAGLPQCPHLYLAADPLDPQRRQEKSCAALGNDKRRQPDGQRQPQQQQQPHCRRGFQAPALPNPLRVLQGLGRVSMSLGWLERPPALSRAAGDGARRLSGSRRGDVWLTSSAAGLLRSVAGGSWCGGQLRARGGSGRCVARAMTGNAGEWCLMESDPGVFTELIKGFGCRGAQVEEIWSLEPENFEKLKRTSRLCGSGLPT

SEQ ID NO: 849914 - protein, 525 aa, Homo sapiens
MSLPRCWFRYPGWTGAEAGRGRAIVSRRLPSLNPWDAGERHGGLVRICASLGPHKRLPAGLPQCPHLYLAADPLDPQRRQEKSCAALGNDKRRQPDGQRQPQQQQQPHCRRGFQAPALPNPLRVLQGLGRVSMSLGWLERPPALSRAAGDGARRLSGSRRGDVWLTSSAAGLLRSVAGGSWCGGQLRARGGSGRCVARAMTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKFEKHFEKTLLGK

SEQ ID NO: 849915 - protein, 134 aa, Homo sapiens
GLFLFCRFYKTKNNFGATYSEGEIRFNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKFEKHFEKTLLGK

SEQ ID NO: 849916 - protein, 409 aa, Homo sapiens
MSLPRCWFRYPGWTGAEAGRGRAIVSRRLPSLNPWDAGERHGGLVRICASLGPHKRLPAGLPQCPHLYLAADPLDPQRRQEKSCAALGNDKRRQPDGQRQPQQQQQPHCRRGFQAPALPNPLRVLQGLGRVSMSLGWLERPPALSRAAGDGARRLSGSRRGDVWLTSSAAGLLRSVAGGSWCGGQLRARGGSGRCVARAMTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQK

SEQ ID NO: 849917 - protein, 138 aa, Homo sapiens [sequence omitted]

SEQ ID NO: 849918 - protein, 527 aa, Homo sapiens; identical to SEQ ID NO: 849909

SEQ ID NO: 849919 - protein, 451 aa, Homo sapiens
MSLPRCWFRYPGWTGAEAGRGRAIVSRRLPSLNPWDAGERHGGLVRICASLGPHKRLPAGLPQCPHLYLAADPLDPQRRQEKSCAALGNDKRRQPDGQRQPQQQQQPHCRRGFQAPALPNPLRVLQGLGRVSMSLGWLERPPALSRAAGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKAKEKQNAKKAQETK

SEQ ID NO: 849920 - protein, 515 aa, Homo sapiens; identical to SEQ ID NO: 849912

SEQ ID NO: 849921 - protein, 525 aa, Homo sapiens; identical to SEQ ID NO: 849914

SEQ ID NO: 849922 - protein, 318 aa, Homo sapiens
MSLPRCWFRYPGWTGAEAGRGRAIVSRRLPSLNPWDAGERHGGLVRICASLGPHKRLPAGLPQCPHLYLAADPLDPQRRQEKSCAALGNDKRRQPDGQRQPQQQQQPHCRRGFQAPALPNPLRVLQGLGRVSMSLGWLERPPALSRAAGDGARRLSGSRRGDVWLTSSAAGLLRSVAGGSWCGGQLRARGGSGRCVARAMTGNAGEWCLMESDPGVFTELIKGFGCRGAQVEEIWSLEPENFEKLKPVHGLIFLFKWQPGEEPAGSVVQDSRLDTIFFAKQVWSLDTLKSLKSNPFYKQDSSLLLFATSVVVLKLLHS

SEQ ID NO: 849923 - protein, 116 aa, Homo sapiens [sequence omitted]

SEQ ID NO: 849924 - protein, 47 aa, Homo sapiens
MVHVYGRVPVAHRHLNVDRCWTEDSVTLNSAGTDAGASGGSVEGQGG

SEQ ID NO: 849925 - protein, 98 aa, Homo sapiens
SRRFFSTSGCFFPLLAEFWGLYGHRMGTGQAVGSFGKGNIQLVKRQYSEITNRERMEVLTLGCGFQAFRLEGGILPATRPCMPTVSLPPVAINFKLPT

SEQ ID NO: 849926 - protein, 244 aa, Homo sapiens
MQEIIASVDHIKFDLEIAVEQQLGAQPLPFPGMDKSGAAVCEFFLKAACGKGGMCPFRHISGEKTVVCKHWLRGLCKKGDQCEFLHEYDMTKMPECYFYSKFGECSNKECPFLHIDPESKIKDCPWYDRGFCKHGPLCRHRHTRRVICVNYLVGFCPEGPSCKFMHPRFELPMGTTEQPPLPQQTQPPAKQRTPQVIGVMQSQNSSAGNRGPRPLEQVTCYKCGEKGHYANRCTKGHLAFLSGQ

SEQ ID NO: 849927 - protein, 122 aa, Homo sapiens
MVFFGQWLLPSSPHVSLLPTVLRWAVVEALLPAVCGTSPALFFPVPIGSLRARVFHSKTVLCNSQSNNPPLQRSSSLIQLTSQNSSPNQHREPRRSSGSCRVKTAARATGDPGHWSRSPVTR

SEQ ID NO: 849928 - protein, 319 aa, Homo sapiens
MQEIIASVDHIKFDLEIAVEQQLGAQPLPFPGMDKSGAAVCEFFLKAACGKGGMCPFRHISGEKTVVCKHWLRGLCKKGDQCEFLHEYDMTKMPECYFYSKFGECSNKECPFLHIDPESKIKDCPWYDRGFCKHGPLCRHRHTRRVICVNYLVGFCPEGPSCKFMHPRFELPMGTTEQPPLPQQTQPPAKQSNNPPLQRSSSLIQLTSQNSSPNQHREPRRSSGSCRVKTAARATGDPGHWSRSPVTSVARKDTTPTDAPKGTWPFSVDSDSSWSQLRAARGPRCWECAFNCFMRLLARLWLELARRHVGFITLRGHVC

SEQ ID NO: 849929 - protein, 178 aa, Homo sapiens
MQEIIASVDHIKFDLEIAVEQQLGAQPLPFPGMDKSGAAVCEFFLKAACGKGGMCPFRHISGEKTVVCKHWLRGLCKKGDQCEFLHEYDMTKMPECYFYSKFGECSNKECPFLHIDPESKIKDCPWYDRGFCKHGPLCRHRHTRRVICVNYLVGFCPEGPSCKFMHKVTIRHYKGRPP

SEQ ID NO: 849930 - protein, 266 aa, Homo sapiens
MCPFRHISGEKTVVCKHWLRGLCKKGDQCEFLHEYDMTKMPECYFYSKFGECSNKECPFLHIDPESKIKDCPWYDRGFCKHGPLCRHRHTRRVICVNYLVGFCPEGPSCKFMHPRFELPMGTTEQPPLPQQTQPPAKQSNNPPLQRSSSLIQLTSQNSSPNQHREPRRSSGSCRVKTAARATGDPGHWSRSPVTSVARKDTTPTDAPKGTWPFSVDSDSSWSQLRAARGPRCWECAFNCFMRLLARLWLELARRHVGFITLRGHVC

SEQ ID NO: 849931 - protein, 201 aa, Homo sapiens
YFSFLCVCMVFFGQWLLPSSPHVSLLPTVLRWAVVEALLPAVCGTSPALFFPVPIGSLRARVFHSKTVLCNSQSNNPPLQRSSSLIQLTSQNSSPNQHREPRRSSGSCRVKTAARATGDPGHWSRSPVTSVARKDTTPTDAPKGTWPFSVDSDSSWSQLRAARGPRCWECAFNCFMRLLARLWLELARRHVGFITLRGHVC

SEQ ID NO: 849932 - protein, 160 aa, Homo sapiens
PRAAAAAAARRSEGGVCAAGPAAGKGEKAAGQSNNPPLQRSSSLIQLTSQNSSPNQHREPRRSSGSCRVKTAARATGDPGHWSRSPVTSVARKDTTPTDAPKGTWPFSVDSDSSWSQLRAARGPRCWECAFNCFMRLLARLWLELARRHVGFITLRGHVC

SEQ ID NO: 849933 - protein, 178 aa, Homo sapiens; identical to SEQ ID NO: 849929

SEQ ID NO: 849934 - protein, 134 aa, Homo sapiens
LGRRRRRRRGEAKEECVRRGRRRVKARRLQDREPRRSSGSCRVKTAARATGDPGHWSRSPVTSVARKDTTPTDAPKGTWPFSVDSDSSWSQLRAARGPRCWECAFNCFMRLLARLWLELARRHVGFITLRGHVC

SEQ ID NO: 849935 - protein, 244 aa, Homo sapiens; identical to SEQ ID NO: 849926

SEQ ID NO: 849936 - protein, 108 aa, Homo sapiens
KTVVCKHWLRGLCKKGDQCEFLHEYDMTKMPECYFYSKFGKAPGALEALLRTRVQRGPLAAQCPHCLCLLFPSFYSQRRTLAEPASLSQLLGDSVAIFCSSLFFFFFF

SEQ ID NO: 849937 - protein, 331 aa, Homo sapiens
SLAPPSLRLAAAMQEIIASVDHIKFDLEIAVEQQLGAQPLPFPGMDKSGAAVCEFFLKAACGKGGMCPFRHISGEKTVVCKHWLRGLCKKGDQCEFLHEYDMTKMPECYFYSKFGECSNKECPFLHIDPESKIKDCPWYDRGFCKHGPLCRHRHTRRVICVNYLVGFCPEGPSCKFMHPRFELPMGTTEQPPLPQQTQPPAKQSNNPPLQRSSSLIQLTSQNSSPNQHREPRRSSGSCRVKTAARATGDPGHWSRSPVTSVARKDTTPTDAPKGTWPFSVDSDSSWSQLRAARGPRCWECAFNCFMRLLARLWLELARRHVGFITLRGHVC

SEQ ID NO: 849938 - protein, 319 aa, Homo sapiens; identical to SEQ ID NO: 849928

SEQ ID NO: 849939 - protein, 125 aa, Homo sapiens
MCPFRHISGEKTVVCKHWLRGLCKKGDQCEFLHEYDMTKMPECYFYSKFGECSNKECPFLHIDPESKIKDCPWYDRGFCKHGPLCRHRHTRRVICVNYLVGFCPEGPSCKFMHKVTIRHYKGRPP

SEQ ID NO: 849940 - protein, 336 aa, Homo sapiens
ETSSSGSRDAPLGFRTPDSQAPISTVWGLLLPSLGLRSSLPRIFGPLRLFKESGAAVCEFFLKAACGKGGMCPFRHISGEKTVVCKHWLRGLCKKGDQCEFLHEYDMTKMPECYFYSKFGECSNKECPFLHIDPESKIKDCPWYDRGFCKHGPLCRHRHTRRVICVNYLVGFCPEGPSCKFMHPRFELPMGTTEQPPLPQQTQPPAKQSNNPPLQRSSSLIQLTSQNSSPNQHREPRRSSGSCRVKTAARATGDPGHWSRSPVTSVARKDTTPTDAPKGTWPFSVDSDSSWSQLRAARGPRCWECAFNCFMRLLARLWLELARRHVGFITLRGHVC

SEQ ID NO: 849941 - protein, 139 aa, Homo sapiens
LGRRRRRRRGEAKEECVRRGRRRVKARRLQETEGEPGRWGRRRRHAGNHRQPRATGDPGHWSRSPVTSVARKDTTPTDAPKGTWPFSVDSDSSWSQLRAARGPRCWECAFNCFMRLLARLWLELARRHVGFITLRGHVC

SEQ ID NO: 849942 - protein, 262 aa, Homo sapiens
MQEIIASVDHIKFDLEIAVEQQLGAQPLPFPGMDKSGAAVCEFFLKAACGKGGMCPFRHISGEKTVVCKHWLRGLCKKGDQCEFLHEYDMTKMPECYFYSKFGECSNKECPFLHIDPESKIKDCPWYDRGFCKHALDLNCPWEPPSSPHCRSRHSLQQSREPRRSSGSCRVKTAARATGDPGHWSRSPVTSVARKDTTPTDAPKGTWPFSVDSDSSWSQLRAARGPRCWECAFNCFMRLLARLWLELARRHVGFITLRGHVC

SEQ ID NO: 849943 - protein, 244 aa, Homo sapiens; identical to SEQ ID NO: 849926

SEQ ID NO: 849944 - protein, 68 aa, Homo sapiens
VSRTQACLRSARRSAVRVFESLGCFLGSVVLGVLSACDSLARDCGRVTEWARGRHCVCVILTVCGGSF

SEQ ID NO: 849945 - protein, 68 aa, Homo sapiens; identical to SEQ ID NO: 849944

SEQ ID NO: 849946 - protein, 109 aa, Homo sapiens
MELRCWTCLAPRTYSPAEQIMNVTHKLPAYHQTHASTYHQTPRVTEECRSAPCCLGIINQPRNHPIKSPASLCFLAVSSSSTDSACCSLITYFDTVFNKSAFLHPQLSW

SEQ ID NO: 849947 - protein, 68 aa, Homo sapiens; identical to SEQ ID NO: 849944

SEQ ID NO: 849948 - protein, 68 aa, Homo sapiens; identical to SEQ ID NO: 849944

SEQ ID NO: 849949 - protein, 68 aa, Homo sapiens; identical to SEQ ID NO: 849944

SEQ ID NO: 849950 - protein, 68 aa, Homo sapiens; identical to SEQ ID NO: 849944

SEQ ID NO: 849951 - protein, 68 aa, Homo sapiens; identical to SEQ ID NO: 849944

SEQ ID NO: 849952 - protein, 68 aa, Homo sapiens; identical to SEQ ID NO: 849944

SEQ ID NO: 849953 - protein, 3024 aa, Homo sapiens
GARAARTRVPRSVPGGRAAFSPDPPSGGGGEMRGGVLLVLLLCVAAQCRQRGLFPAILNLASNAHISTNATCGEKGPEMFCKLVEHVPGRPVRNPQCRICDGNSANPRERHPISHAIDGTNNWWQSPSIQNGREYHWVTITLDLRQVFQVAYVIIKAANAPRPGNWILERSLDGTTFSPWQYYAVSDSECLSRYNITPRRGPPTYRADDEVICTSYYSRLVPLEHGEIHTSLINGRPSADDLSPKLLEFTSARYIRLRFERIRTLNADLMTLSHREPKELDPMLPRRYYYSIKDISVGGMCICYGHASSCPWDETTKKLQCQCEHNTCGESCNRCCPGYHQQPWRPGTVSSGNTCEACNCHNKAKDCYYDESVAKQKKSLNTAGQFRGGGVCINCLQNTMGINCETCIDGYYRPHKVSPYEDEPCRPCNCDPVGSLSSVCIKDDLHSDLENGKQPGQCPCKEGYTGEKCDRCQLGYKDYPTCVSCGCNPVGSASDEPCTGPCVCKENVEGKACDRCKPGFYNLKEKNPRGCSECFCFGVSDVCSSLSWPLGQVNSMSGWLVTDLISPRKIPSQQDALGGRHQVSINNTAVMQRLAPKYYWAAPEAYLGNKLTAFGGFLKYTVSYDIPVETVDSNLMSHADVIIKGNGLTLSTQAEGLSLQPYEEYLNVVRLVPENFQDFHSKRQIDRDQLMTVLANVTHLLIRATYNSAKMALYRLESVSLDIASSNAIDLVVAADVEHCECPQGYTGTSCESCLSGYYRVDGILFGGICQPCECHGHAAECNVHGVCIACAHNTTGVHCEQCLPGFYGEPSRGTPGDCQPCACPLTIASNNFSPTCHLNDGDEVVCDWCAPGYSGAWCERCADGYYGNPTVPGESCVPCDCSGNVDPSEAGHCDSVTGECLKCLGNTDGAHCERCADGFYGDAVTAKNCRACECHVKGSHSAVCHLETGLCDCKPNVTGQQCDQCLHGYYGLDSGHGCRPCNCSVAGSVSDGCTDEGQCHCVPGVAGKRCDRCAHGFYAYQDGSCTPCDCPHTQNTCDPETGECVCPPHTQGVKCEECEDGHWGYDAEVGCQACNCSLVGSTHHRCDVVTGHCQCKSKFGGRACVQCSLGYRDFPDCVPCDCDLRGTSGDACNLEQGLCGCVEETGACPCKENVFGPQCNECREGTFALRADNPLGCSPCFCSGLSHLCSELEDYVRTPVTLGSDQPLLRVVSQSNLRGTTEGVYYQAPDFLLDAATVRQHIRAEPFYWRLPQQFQGDQLMAYGGKLKYSVAFYSLDGVGTSNFEPQVLIKGGRIRKQVIYMDAPAPENGVRQEQEVAMRENFWKYFNSVSEKPVTREDFMSVLSDIEYILIKASYGQGLQQSRISDISMEVGRKAEKLHPEEEVASLLENCVCPPGTVGFSCQDCAPGYHRGKLPAGSDRGPRPLVAPCVPCSCNNHSDTCDPNTGKCLNCGDNTAGDHCDVCTSGYYGKVTGSASDCALCACPHSPPASFSPTCVLEGDHDFRCDACLLGYEGKHCERCSSSYYGNPQTPGGSCQKCDCNPHGSVHGDCDRTSGQCVCRLGASGLRCDECEPRHILMETDCVSCDDECVGVLLNDLDEIGDAVLSLNLTGIIPVPYGILSNLENTTKYLQESLLKENMQKDLGKIKLEGVAEETDNLQKKLTRMLASTQKVNRATERIFKESQDLAVAIERLQMSITEIMEKTTLNQTLDEDFLLPNSTLQNMQQNGTSLLEIMQIRDFTQLHQNATLELKAAEDLLSQIQENYQKPLEELEVLKEAASHVLSKHNNELKAAEALVREAEAKMQESNHLLLMVNANLREFSDKKLHVQEEQNLTSELIVQGRGLIDAAAAQTDAVQDALEHLEDHQDKLLLWSAKIRHHIDDLVMHMSQRNAVDLVYRAEDHAAEFQRLADVLYSGLENIRNVSLNATSAAYVHYNIQSLIEESEELARDAHRTVTETSLLSESLVSNGKAAVQRSSRFLKEGNNLSRKLPGIALELSELRNKTNRFQENAVEITRQTNESLLILRAIPKGIRDKGAKTKELATSASQSAVSTLRDVAGLSQELLNTSASLSRVNTTLRETHQLLQDSTMATLLAGRKVKDVEIQANLLFDRLKPLKMLEENLSRNLSEIKLLISQARKQAASIKVAVSADRDCIRAYQPQISSTNYNTLTLNVKTQEPDNLLFYLGSSTASDFLAVEMRRGRVAFLWDLGSGSTRLEFPDFPIDDNRWHSIHVARFGNIGSLSVKEMSSNQKSPTKTSKSPGTANVLDVNNSTLMFVGGLGGQIKKSPAVKVTHFKGCLGEAFLNGKSIGLWNYIEREGKCRGCFGSSQNEDPSFHFDGSGYSVVEKSLPATVTQIIMLFNTFSPNGLLLYLGSYGTKDFLSIELFRGRVKVMTDLGSGPITLLTDRRYNNGTWYKIAFQRNRKQGVLAVIDAYNTSNKETKQGETPGASSDLNRLDKDPIYVGGLPRSRVVRRGVTTKSFVGCIKNLEISRSTFDLLRNSYGVRKGCLLEPIRSVSFLKGGYIELPPKSLSPESEWLVTFATTNSSGIILAALGGDVEKRGDREEAHVPFFSVMLIGGNIEVHVNPGDGTGLRKALLHAPTGTCSDGQAHSISLVRNRRIITVQLDENNPVEMKLGTLVESRTINVSNLYVGGIPEGEGTSLLTMRRSFHGCIKNLIFNLELLDFNSAVGHEQVDLDTCWLSERPKLAPDAEDSKLLPEPRAFPEQCVVDAALEYVPGAHQFGLTQNSHFILPFNQSAVRKKLSVELSIRTFASSGLIYYMAHQNQADYAVLQLHGGRLHFMFDLGKGRTKVSHPALLSDGKWHTVKTDYVKRKGFITVDGRESPMVTVVGDGTMLDVEGLFYLGGLPSQYQARKIGNITHSIPACIGDVTVNSKQLDKDSPVSAFTVNRCYAVAQEGTYFDGSGYAALVKEGYKVQSDVNITLEFRTSSQNGVLLGISTAKVDAIGLELVDGKVLFHVNNGAGRITAAYEPKTATVLCDGKWHTLPANKKQTPYHSDC

SEQ ID NO: 849954 - protein, 2637 aa, Homo sapiens
GARAARTRVPRSVPGGRAAFSPDPPSGGGGEMRGGVLLVLLLCVAAQCRQRGLFPAILNLASNAHISTNATCGEKGPEMFCKLVEHVPGRPVRNPQCRICDGNSANPRERHPISHAIDGTNNWWQSPSIQNGREYHWVTITLDLRQVFQVAYVIIKAANAPRPGNWILERSLDGTTFSPWQYYAVSDSECLSRYNITPRRGPPTYRADDEVICTSYYSRLVPLEHGEIHTSLINGRPSADDLSPKLLEFTSARYIRLRFERIRTLNADLMTLSHREPKELDPMLPRRYYYSIKDISVGGMCICYGHASSCPWDETTKKLQCQCEHNTCGESCNRCCPGYHQQPWRPGTVSSGNTCEACNCHNKAKDCYYDESVAKQKKSLNTAGQFRGGGVCINCLQNTMGINCETCIDGYYRPHKVSPYEDEPCRPCNCDPVGSLSSVCIKDDLHSDLENGKQPGQCPCKEGYTGEKCDRCQLGYKDYPTCVSCGCNPVGSASDEPCTGPCVCKENVEGKACDRCKPGFYNLKEKNPRGCSECFCFGVSDVCSSLSWPLGQVNSMSGWLVTDLISPRKIPSQQDALGGRHQVSINNTAVMQRLAPKYYWAAPEAYLGNKLTAFGGFLKYTVSYDIPVETVDSNLMSHADVIIKGNGLTLSTQAEGLSLQPYEEYLNVVRLVPENFQDFHSKRQIDRDQLMTVLANVTHLLIRATYNSAKMALYRLESVSLDIASSNAIDLVVAADVEHCECPQGYTGTSCESCLSGYYRVDGILFGGICQPCECHGHAAECNVHGVCIACAHNTTGVHCEQCLPGFYGEPSRGTPGDCQPCACPLTIASNNFSPTCHLNDGDEVVCDWCAPGYSGAWCERCADGYYGNPTVPGESCVPCDCSGNVDPSEAGHCDSVTGECLKCLGNTDGAHCERCADGFYGDAVTAKNCRACECHVKGSHSAVCHLETGLCDCKPNVTGQQCDQCLHGYYGLDSGHGCRPCNCSVAGSVSDGCTDEGQCHCVPGVAGKRCDRCAHGFYAYQDGSCTPCDCPHTQNTCDPETGECVCPPHTQGVKCEECEDGHWGYDAEVGCQACNCSLVGSTHHRCDVVTGHCQCKSKFGGRACVQCSLGYRDFPDCVPCDCDLRGTSGDACNLEQGLCGCVEETGACPCKENVFGPQCNECREGTFALRADNPLGCSPCFCSGLSHLCSELEDYVRTPVTLGSDQPLLRVVSQSNLRGTTEGVYYQAPDFLLDAATVRQHIRAEPFYWRLPQQFQGDQLMAYGGKLKYSVAFYSLDGVGTSNFEPQVLIKGGRIRKQVIYMDAPAPENGVRQEQEVAMRENFWKYFNSVSEKPVTREDFMSVLSDIEYILIKASYGQGLQQSRISDISMEVGRKAEKLHPEEEVASLLENCVCPPGTVGFSCQDCAPGYHRGKLPAGSDRGPRPLVAPCVPCSCNNHSDTCDPNTGKCLNCGDNTAGDHCDVCTSGYYGKVTGSASDCALCACPHSPPASFSPTCVLEGDHDFRCDACLLGYEGKHCERCSSSYYGNPQTPGGSCQKCDCNPHGSVHGDCDRTSGQCVCRLGASGLRCDECEPRHILMETDCVSCDDECVGVLLNDLDEIGDAVLSLNLTGIIPVPYGILSNLENTTKYLQESLLKENMQKDLGKIKLEGVAEETDNLQKKLTRMLASTQKVNRATERIFKESQDLAVAIERLQMSITEIMEKTTLNQTLDEDFLLPNSTLQNMQQNGTSLLEIMQIRDFTQLHQNATLELKAAEDLLSQIQENYQKPLEELEVLKEAASHVLSKHNNELKAAEALVREAEAKMQESNHLLLMVNANLREFSDKKLHVQEEQNLTSELIVQGRGLIDAAAAQTDAVQDALEHLEDHQDKLLLWSAKIRHHIDDLVMHMSQRNAVDLVYRAEDHAAEFQRLADVLYSGLENIRNVSLNATSAAYVHYNIQSLIEESEELARDAHRTVTETSLLSESLVSNGKAAVQRSSRFLKEGNNLSRKLPGIALELSELRNKTNRFQENAVEITRQTNESLLILRAIPKGIRDKGAKTKELATSASQSAVSTLRDVAGLSQELLNTSASLSRVNTTLRETHQLLQDSTMATLLAGRKVKDVEIQANLLFDRLKPLKMLEENLSRNLSEIKLLISQARKQAASIKVAVSADRDCIRAYQPQISSTNYNTLTLNVKTQEPDNLLFYLGSSTASDFLAVEMRRGRVAFLWDLGSGSTRLEFPDFPIDDNRWHSIHVARFGNIGSLSVKEMSSNQKSPTKTSKSPGTANVLDVNNSTLMFVGGLGGQIKKSPAVKVTHFKGCLGEAFLNGKSIGLWNYIEREGKCRGCFGSSQNEDPSFHFDGSGYSVVEKSLPATVTQIIMLFNTFSPNGLLLYLGSYGTKDFLSIELFRGRVKVMTDLGSGPITLLTDRRYNNGTWYKIAFQRNRKQGVLAVIDAYNTSNKETKQGETPGASSDLNRLDKDPIYVGGLPRSRVVRRGVTTKSFVGCIKNLEISRSTFDLLRNSYGVRKGCLLEPIRSVSFLKGGYIELPPKSLSPESEWLVTFATTNSSGIILAALGGDVEKRGDREEAHVPFFSVMLIGGNIEVHVNPGDGTGLRKALLHAPTGTCSDGQAHSISLVRNRRYLHAARQCVMKVW

SEQ ID NO: 849955 - protein, 146 aa, Homo sapiens
MALHGGTRVCQWGSGCGWRLSVPVCLLQEQCVVDAALEYVPGAHQFGLTQNSHFILPFNQSAVRKNCLSLGPFCQGKISRPGAWGSRTPCCSSLLLRSSSSPARLACSLCHALPVLLSLAVPPCHTPLDLGSCLSSAAPAITLCEF

SEQ ID NO: 849956 - protein, 2796 aa, Homo sapiens
GARAARTRVPRSVPGGRAAFSPDPPSGGGGEMRGGVLLVLLLCVAAQCRQRGLFPAILNLASNAHISTNATCGEKGPEMFCKLVEHVPGRPVRNPQCRICDGNSANPRERHPISHAIDGTNNWWQSPSIQNGREYHWVTITLDLRQVFQVAYVIIKAANAPRPGNWILERSLDGTTFSPWQYYAVSDSECLSRYNITPRRGPPTYRADDEVICTSYYSRLVPLEHGEIHTSLINGRPSADDLSPKLLEFTSARYIRLRFERIRTLNADLMTLSHREPKELDPMLPRRYYYSIKDISVGGMCICYGHASSCPWDETTKKLQCQCEHNTCGESCNRCCPGYHQQPWRPGTVSSGNTCEACNCHNKAKDCYYDESVAKQKKSLNTAGQFRGGGVCINCLQNTMGINCETCIDGYYRPHKVSPYEDEPCRPCNCDPVGSLSSVCIKDDLHSDLENGKQPGQCPCKEGYTGEKCDRCQLGYKDYPTCVSCGCNPVGSASDEPCTGPCVCKENVEGKACDRCKPGFYNLKEKNPRGCSECFCFGVSDVCSSLSWPLGQVNSMSGWLVTDLISPRKIPSQQDALGGRHQVSINNTAVMQRLAPKYYWAAPEAYLGNKLTAFGGFLKYTVSYDIPVETVDSNLMSHADVIIKGNGLTLSTQAEGLSLQPYEEYLNVVRLVPENFQDFHSKRQIDRDQLMTVLANVTHLLIRATYNSAKMALYRLESVSLDIASSNAIDLVVAADVEHCECPQGYTGTSCESCLSGYYRVDGILFGGICQPCECHGHAAECNVHGVCIACAHNTTGVHCEQCLPGFYGEPSRGTPGDCQPCACPLTIASNNFSPTCHLNDGDEVVCDWCAPGYSGAWCERCADGYYGNPTVPGESCVPCDCSGNVDPSEAGHCDSVTGECLKCLGNTDGAHCERCADGFYGDAVTAKNCRACECHVKGSHSAVCHLETGLCDCKPNVTGQQCDQCLHGYYGLDSGHGCRPCNCSVAGSVSDGCTDEGQCHCVPGVAGKRCDRCAHGFYAYQDGSCTPCDCPHTQNTCDPETGECVCPPHTQGVKCEECEDGHWGYDAEVGCQACNCSLVGSTHHRCDVVTGHCQCKSKFGGRACVQCSLGYRDFPDCVPCDCDLRGTSGDACNLEQGLCGCVEETGACPCKENVFGPQCNECREGTFALRADNPLGCSPCFCSGLSHLCSELEDYVRTPVTLGSDQPLLRVVSQSNLRGTTEGVYYQAPDFLLDAATVRQHIRAEPFYWRLPQQFQGDQLMAYGGKLKYSVAFYSLDGVGTSNFEPQVLIKGGRIRKQVIYMDAPAPENGVRQEQEVAMRENFWKYFNSVSEKPVTREDFMSVLSDIEYILIKASYGQGLQQSRISDISMEVGRKAEKLHPEEEVASLLENCVCPPGTVGFSCQDCAPGYHRGKLPAGSDRGPRPLVAPCVPCSCNNHSDTCDPNTGKCLNCGDNTAGDHCDVCTSGYYGKVTGSASDCALCACPHSPPASFSPTCVLEGDHDFRCDACLLGYEGKHCERCSSSYYGNPQTPGGSCQKCDCNPHGSVHGDCDRTSGQCVCRLGASGLRCDECEPRHILMETDCVSCDDECVGVLLNDLDEIGDAVLSLNLTGIIPVPYGILSNLENTTKYLQESLLKENMQKDLGKIKLEGVAEETDNLQKKLTRMLASTQKVNRATERIFKESQDLAVAIERLQMSITEIMEKTTLNQTLDEDFLLPNSTLQNMQQNGTSLLEIMQIRDFTQLHQNATLELKAAEDLLSQIQENYQKPLEELEVLKEAASHVLSKHNNELKAAEALVREAEAKMQESNHLLLMVNANLREFSDKKLHVQEEQNLTSELIVQGRGLIDAAAAQTDAVQDALEHLEDHQDKLLLWSAKIRHHIDDLVMHMSQRNAVDLVYRAEDHAAEFQRLADVLYSGLENIRNVSLNATSAAYVHYNIQSLIEESEELARDAHRTVTETSLLSESLVSNGKAAVQRSSRFLKEGNNLSRKLPGIALELSELRNKTNRFQENAVEITRQTNESLLILRAIPKGIRDKGAKTKELATSASQSAVSTLRDVAGLSQELLNTSASLSRVNTTLRETHQLLQDSTMATLLAGRKVKDVEIQANLLFDRLKPLKMLEENLSRNLSEIKLLISQARKQAASIKVAVSADRDCIRAYQPQISSTNYNTLTLNVKTQEPDNLLFYLGSSTASDFLAVEMRRGRVAFLWDLGSGSTRLEFPDFPIDDNRWHSIHVARFGNIGSLSVKEMSSNQKSPTKTSKSPGTANVLDVNNSTLMFVGGLGGQIKKSPAVKVTHFKGCLGEAFLNGKSIGLWNYIEREGKCRGCFGSSQNEDPSFHFDGSGYSVVEKSLPATVTQIIMLFNTFSPNGLLLYLGSYGTKDFLSIELFRGRVKVMTDLGSGPITLLTDRRYNNGTWYKIAFQRNRKQGVLAVIDAYNTSNKETKQGETPGASSDLNRLDKDPIYVGGLPRSRVVRRGVTTKSFVGCIKNLEISRSTFDLLRNSYGVRKGCLLEPIRSVSFLKGGYIELPPKSLSPESEWLVTFATTNSSGIILAALGGDVEKRGDREEAHVPFFSVMLIGGNIEVHVNPGDGTGLRKALLHAPTGTCSDGQAHSISLVRNRRIITVQLDENNPVEMKLGTLVESRTINVSNLYVGGIPEGEGTSLLTMRRSFHGCIKNLIFNLELLDFNSAVGHEQVDLDTCWLSERPKLAPDAEDSKLLPEPRAFPVGAASFTISQVQSAKEGLGQRELKWGLAVKVPAKAGAGAGAGAVLKIRAGTGRERVPQATQMTRPNP

SEQ ID NO: 849957 - protein, 448 aa, Homo sapiens
QPRGTRRPAPEGAAASGHSAGAERELPGGEAPQAPGGQGGAGQDGRLRKCHPAHPGLSLLPGTSADGALAGRGCMGLPRGSFFWLLLLLTAACSGLLFALYFSAVQRYPGPAAGARDTTSFEAFFQSKASNSWTGKGQACRHLLHLAIQRHPHFRGLFNLSIPVLLWGDLFTPALWDRLSQHKAPYGWRGLSHQVIASTLSLLNGSESAKLFAPPRDTPPKCIRCAVVGNGGILNGSRQGPNIDAHDYVFRLNGAVIKGFERDVGTKTSFYGFTVNTMKNSLVSYWNLGFTSVPQGQDLQYIFIPSDIRDYVMLRSAILGVPVPEGLDKGDRPHAYFGPEASASKFKLLHPDFISYLTERFLKSKLINTHFGDLYMPSTGALMLLTALHTCDQVSAYGFITSNYWKFSDHYFERKMKPLIFYANHDLSLEAALWRDLHKAGILQLYQR

SEQ ID NO: 849958 - protein, 227 aa, Homo sapiens
QPRGTRRPAPEGAAASGHSAGAERELPGGEAPQAPGGQGGAGQDGRLRKCHPAHPGLSLLPGTSADGALAGRGCMGLPRGSFFWLLLLLTAACSGLLFALYFSAVQRYPGPAAGASCQPRVPSTCGCWGEGRGLREAWHLLKGDTTSFEAFFQSKASNSWTGKGQACRHLLHLAIQRHPHFRGLFNLSIPVLLWGDLFTPALWDRLSQHKAPYGWRGLSHQGNPRPL

SEQ ID NO: 849959 - protein, 428 aa, Homo sapiens
PAPGDPPPSSRGCGSLWPLSRGREGAAGRGGAAGTRRAGRGRARRPPPQVPPGPPGPLPSAWDVSGRGARGPGLYGAPARVVLLAAAPAHGCLLGAPLCPVLLGGAAVPGASGRSQGQACRHLLHLAIQRHPHFRGLFNLSIPVLLWGDLFTPALWDRLSQHKAPYGWRGLSHQVIASTLSLLNGSESAKLFAPPRDTPPKCIRCAVVGNGGILNGSRQGPNIDAHDYVFRLNGAVIKGFERDVGTKTSFYGFTVNTMKNSLVSYWNLGFTSVPQGQDLQYIFIPSDIRDYVMLRSAILGVPVPEGLDKGDRPHAYFGPEASASKFKLLHPDFISYLTERFLKSKLINTHFGDLYMPSTGALMLLTALHTCDQVSAYGFITSNYWKFSDHYFERKMKPLIFYANHDLSLEAALWRDLHKAGILQLYQR

SEQ ID NO: 849960 - protein, 333 aa, Homo sapiens
MDTTSFEAFFQSKASNSWTGKGQACRHLLHLAIQRHPHFRGLFNLSIPVLLWGDLFTPALWDRLSQHKAPYGWRGLSHQVIASTLSLLNGSESAKLFAPPRDTPPKCIRCAVVGNGGILNGSRQGPNIDAHDYVFRLNGAVIKGFERDVGTKTSFYGFTVNTMKNSLVSYWNLGFTSVPQGQDLQYIFIPSDIRDYVMLRSAILGVPVPEGLDKGDRPHAYFGPEASASKFKLLHPDFISYLTERFLKSKLINTHFGDLYMPSTGALMLLTALHTCDQVSAYGFITSNYWKFSDHYFERKMKPLIFYANHDLSLEAALWRDLHKAGILQLYQR

SEQ ID NO: 849961 - protein, 420 aa, Homo sapiens
QPRGTRRPAPEGAAASGHSAGAERELPGGEAPQAPGGQGGAGQDGRLRKCHPAHPGLSLLPGTSADGALAGRGCMGLPRGSFFWLLLLLTAACSGLLFALYFSAVQRYPGPAAGARDTTSFEAFFQSKASNSWTGKGQACRHLLHLAIQRHPHFRGLFNLSIPVLLWGDLFTPALWDRLSQHKAPYGWRGLSHQVIASTLSLLNGSESAKLFAPPRDTPPKCIRCAVVGNGGILNGSRQGPNIDAHDYVFRLNGAVIKGFERDVGTKTSFYGFTVNTMKNSLVSYWNLGFTSVPQGQDLQYIFIPSDIRDYVMLRSAILGVPVPEGLDKGDRFLKSKLINTHFGDLYMPSTGALMLLTALHTCDQVSAYGFITSNYWKFSDHYFERKMKPLIFYANHDLSLEAALWRDLHKAGILQLYQR

SEQ ID NO: 849962 - protein, 448 aa, Homo sapiens; identical to SEQ ID NO: 849957

SEQ ID NO: 849963 - protein, 103 aa, Homo sapiens
PHLLSGISPRPLSSPQQTDTFLNSCHFTQVSVHTRRSTNTNPATILAQVSAYGFITSNYWKFSDHYFERKMKPLIFYANHDLSLEAALWRDLHKAGILQLYQR

SEQ ID NO: 849964 - protein, 448 aa, Homo sapiens; identical to SEQ ID NO: 849957

SEQ ID NO: 849965 - protein, 457 aa, Homo sapiens
QPRGTRRPAPEGAAASGHSAGAERELPGGEAPQAPGGQGGAGQDGRLRKCHPAHPGLSLLPGTSADGALAGRGCMGLPRGSFFWLLLLLTAACSGLLFALYFSAVQRYPGPAAGARDTTSFEAFFQSKASNSWTGKGQACRHLLHLAIQRHPHFRGLFNLSIPVLLWGDLFTPALWDRLSQHKAPYGWRGLSHQVIASTLSLLNGSESAKLFAPPRDTPPKCIRCAVVGNGGILNGSRQGPNIDAHDYVFRHCWASVPTRLNGAVIKGFERDVGTKTSFYGFTVNTMKNSLVSYWNLGFTSVPQGQDLQYIFIPSDIRDYVMLRSAILGVPVPEGLDKGDRPHAYFGPEASASKFKLLHPDFISYLTERFLKSKLINTHFGDLYMPSTGALMLLTALHTCDQVSAYGFITSNYWKFSDHYFERKMKPLIFYANHDLSLEAALWRDLHKAGILQLYQR

SEQ ID NO: 849966 - protein, 487 aa, Homo sapiens
QPRGTRRPAPEGAAASGHSAGAERELPGGEAPQAPGGQGGAGQDGRLRKCHPAHPGLSLLPGTSADGALAGRGCMGLPRGSFFWLLLLLTAACSGLLFALYFSAVQRYPGPAAGARDTTSFEAFFQSKASNSWTGKGQACRHLLHLAIQRHPHFRGLFNLSIPVLLWGDLFTPALWDRLSQHKAPYGWRGLSHQVIASTLSLLNGSESAKLFAPPRDTPPKCIRCAVVGNGGILNGSRQGPNIDAHDYVFRLNGAVIKGFERDVGTKTSFYGFTVNTMKNSLVSYWNLGFTSVPQGQDLQYIFIPSDIRDYVMLRSAILGVPVPEGLDKGDSPAPTAQGTAATPAPWPSPPSPPCNTTALGALSTSIMGPRPHAYFGPEASASKFKLLHPDFISYLTERFLKSKLINTHFGDLYMPSTGALMLLTALHTCDQVSAYGFITSNYWKFSDHYFERKMKPLIFYANHDLSLEAALWRDLHKAGILQLYQR

SEQ ID NO: 849967 - protein, 346 aa, Homo sapiens
QPRGTRRPAPEGAAASGHSAGAERELPGGEAPQAPGGQGGAGQDGRLRKCHPAHPGLSLLPGTSADGALAGRGCMGLPRGSFFWLLLLLTAACSGLLFALYFSAVQRYPGPAAGARDTTSFEAFFQSKASNSWTGKGQACRHLLHLAIQRHPHFRGLFNLSIPVLLWGDLFTPALWDRLSQHKAPYGWRGLSHQVIASTLSLLNGSESAKLFAPPRDTPPKCIRCAVVGNGGILNGSRQGPNIDAHDYVFRLNGAVIKGFERDVGTKTSFYGFTVNTMKNSLVSYWNLGFTSVPQGQDLQYIFIPSDIRDYVMLRSAILGVPVPEGLDKGDSPAPTAQGTAATPAP

SEQ ID NO: 849968 - protein, 88 aa, Homo sapiens
DFYEDPLQSVYADLYMPSTGALMLLTALHTCDQVSAYGFITSNYWKFSDHYFERKMKPLIFYANHDLSLEAALWRDLHKAGILQLYQR

SEQ ID NO: 849969 - protein, 346 aa, Homo sapiens; identical to SEQ ID NO: 849967

SEQ ID NO: 849970 - protein, 219 aa, Homo sapiens
MKDNDIKRLLYTHLLCIFSIILSVFIPSLFLENFSILETHLTWLCICSGFVTAVNLVLYLVVKPNTSSKRSSLSHKVTGFLKCCIYFLMSCFSFHVIFVLYGAPLIELALETFLFAVILSTFTTVPCLCLLGPNLKAWLRVFSRNGVTSIWENSLQITTISSFVGAWLGALPIPLDWERPWQVWPISCTLGATFGYVAGLVISPLWIYWNRKQLTYKNN

SEQ ID NO: 849971 - protein, 206 aa, Homo sapiens
MKDNDIKRLLYTHLLCIFSIILSVFIPSLFLENFSILETHLTWLCICSGFVTAVNLVLYLVVKPNTSSKRSSLSHKVTGFLKCCIYFLMSCFSFHVIFVLYGAPLIELALETFLFAVILSTFTTVPCLCLLGPNLKAWLRVFSRNGVTSIWENSLQITTISSFVGAWLGALPIPLDWERPWQMTVERKRSTYRSLHVPCRGLGTVK

SEQ ID NO: 849972 - protein, 201 aa, Homo sapiens
MKDNDIKRLLYTHLLCIFSIILSVFIPSLFLENFSILETHLTWLCICSGFVTAVNLVLYLVVKPNTSSFLMSCFSFHVIFVLYGAPLIELALETFLFAVILSTFTTVPCLCLLGPNLKAWLRVFSRNGVTSIWENSLQITTISSFVGAWLGALPIPLDWERPWQVWPISCTLGATFGYVAGLVISPLWIYWNRKQLTYKNN

SEQ ID NO: 849973 - protein, 131 aa, Homo sapiens
MSCFSFHVIFVLYGAPLIELALETFLFAVILSTFTTVPCLCLLGPNLKAWLRVFSRNGVTSIWENSLQITTISSFVGAWLGALPIPLDWERPWQVWPISCTLGATFGYVAGLVISPLWIYWNRKQLTYKNN

SEQ ID NO: 849974 - protein, 227 aa, Homo sapiens
MKDNDIKRLLYTHLLCIFSIILSVFIPSLFLENFSILETHLTWLCICSGFVTAVNLVLYLVVKPNTSSKRSSLSHKVTGFLKCCIYFLMSCFSFHVIFVLYGAPLIELALETFLFAVILSTFTTVPCLCLLGPNLKAWLRVFSRNGVTSIWENSLQITTISSFVGAWLGALPIPLDWERPWQGAWYCEMSNLILTTVVQGMAHLLYAWSDLWLRGWPCYFTTLDILE

SEQ ID NO: 849975 - protein, 244 aa, Homo sapiens
MPAKAPLGAARKSLLSAALAIQENTMKDNDIKRLLYTHLLCIFSIILSVFIPSLFLENFSILETHLTWLCICSGFVTAVNLVLYLVVKPNTSSKRSSLSHKVTGFLKCCIYFLMSCFSFHVIFVLYGAPLIELALETFLFAVILSTFTTVPCLCLLGPNLKAWLRVFSRNGVTSIWENSLQITTISSFVGAWLGALPIPLDWERPWQVWPISCTLGATFGYVAGLVISPLWIYWNRKQLTYKNN

SEQ ID NO: 849976 - protein, 187 aa, Homo sapiens
MKDNDIKRLLYTHLLCIFSIILSVFIPSLFLENFSILETHLTWLCICSGFVTAVNLVLYLVVKPNTSSKRSSLSHKVTGFLKCCIYFLMSCFSFHVIFVLYGAPLIELALETFLFAVILSTFTTVPCLCLLGPNLKAWLRVFSRNGVTSIWENSLQITTISSFVGAWLGALPIPLDWERPWQKQIAR

SEQ ID NO: 849977 - protein, 366 aa, Homo sapiens
QRAGAAAMLSAASRVVSRAAVHCALRSPPPEARALAMSRPPPPRVASVLGTMEMGRRMDAPASAAAVRAFLERGHTELDTAFMYSDGQSETILGGLGLGLGGGDCRVKIATKANPWDGKSLKPDSVRSQLETSLKRLQCPQVDLFYLHAPDHGTPVEETLHACQRLHQEGKFVELGLSNYASWEVAEICTLCKSNGWILPTVYQGMYNATTRQVETELFPCLRHFGLRFYAYNPLAGGLLTGKYKYEDKDGKQPVGRFFGNSWAETYRNRFWKEHHFEAIALVEKALQAAYGASAPSVTSAALRWMYHHSQLQGAHGDAVILGMSSLEQLEQNLAATEEGPLEPAVVDAFNQAWHLVAHECPNYFR

SEQ ID NO: 849978 - protein, 207 aa, Homo sapiens
QRAGAAAMLSAASRVVSRAAVHCALRSPPPEARALAMSRPPPPRVASVLGTMEMGRRMDAPASAAAVRAFLERGHTELDTAFMYSDGQSETILGGLGLGLGGGDCRVKIATKANPWDGKSLKPDSVRSQLETSLKRLQCPQVDLFYLHAPDHGTPVEETLHACQRLHQEGKFVELGLSNYASWEVAEICTLCKSNGWILPTVYQGAC

SEQ ID NO: 849979 - protein, 299 aa, Homo sapiens
QRAGAAAMLSAASRVVSRAAVHCALRSPPPEARALAMSRPPPPRVASVLGTMEMGRRMDAPASAAAVRAFLERGHTELDTAFMYSDGQSETILGGLGLGLGGGDCRVKIATKANPWDGKSLKPDSVRSQLETSLKRLQCPQVDLFYLHAPDHGTPVEETLHACQRLHQEVTEAAAVSRVDLFYLHAPDHSAPVEETLRACHQLHQEGKFVELGLSNYAAWEVAEICTLCKSNGWILPTVYQGMYSATTRQVETELFPCLRHFGLRFYAYNPLAGGLLTGKYKYEDKDGKQPVGRFFGTQ

SEQ ID NO: 849980 - protein, 366 aa, Homo sapiens; identical to SEQ ID NO: 849977

SEQ ID NO: 849981 - protein, 345 aa, Homo sapiens
RAAPGLSQSPVAAVMSRQLSRARPASVLGTMEMGRRMDAPASAAAVRAFLERGHTELDTAFMYSDGQSETILGGLGLGLGGGDCRVKIATKANPWDGKSLKPDSVRSQLETSLKRLQCPQVDLFYLHAPDHGTPVEETLHACQRLHQEGKFVELGLSNYASWEVAEICTLCKSNGWILPTVYQGMYNATTRQVETELFPCLRHFGLRFYAYNPLAGGLLTGKYKYEDKDGKQPVGRFFGNSWAETYRNRFWKEHHFEAIALVEKALQAAYGASAPSVTSAALRWMYHHSQLQGAHGDAVILGMSSLEQLEQNLAATEEGPLEPAVVDAFNQAWHLVAHECPNYFR

SEQ ID NO: 849982 - protein, 150 aa, Homo sapiens
MAASQCLCCSKFLFQRQNLACFLTNPHCGSLVNADGHGEVWTDWNNMSKFFQYGWRCTTNENTYSNRTLMGNWNQERYDLRNIVQPKPLPSQFGHYFETTYDTSYNNKMPLSTHRFKREPHWFPGHQPELDPPRYKCTEKSTYMNSYSKP

SEQ ID NO: 849983 - protein, 170 aa, Homo sapiens
FRRGAGSLPRSRRHCRFSQASGSRANSAGRWRQVARQNLACFLTNPHCGSLVNADGHGEVWTDWNNMSKFFQYGWRCTTNENTYSNRTLMGNWNQERYDLRNIVQPKPLPSQFGHYFETTYDTSYNNKMPLSTHRFKREPHWFPGHQPELDPPRYKCTEKSTYMNSYSKP

SEQ ID NO: 849984 - protein, 121 aa, Homo sapiens
MAASQCLCCSKFLFQRQNLACFLTNPHCGSLVNADGHGEVWTDWNNMSKFFQYGWRCTTNENTYSNRTLMGNWNQERYDLRNIVQPKPLPSQDLSESLTGSQDINLNWILPDTNAQKSQLT

SEQ ID NO: 849985 - protein, 170 aa, Homo sapiens; identical to SEQ ID NO: 849983

SEQ ID NO: 849986 - protein, 150 aa, Homo sapiens; identical to SEQ ID NO: 849982

SEQ ID NO: 849987 - protein, 121 aa, Homo sapiens; identical to SEQ ID NO: 849984

SEQ ID NO: 849988 - protein, 161 aa, Homo sapiens [sequence omitted]

SEQ ID NO: 849989 - protein, 161 aa, Homo sapiens [sequence omitted]

SEQ ID NO: 849990 - protein, 161 aa, Homo sapiens [sequence omitted]

SEQ ID NO: 849991 - protein, 161 aa, Homo sapiens [sequence omitted]

SEQ ID NO: 849992 - protein, 161 aa, Homo sapiens [sequence omitted]

SEQ ID NO: 849993 - protein, 161 aa, Homo sapiens [sequence omitted]

SEQ ID NO: 849994 - protein, 112 aa, Homo sapiens
MSGSQSEVAPSPQSPRSPEMGRDLRPGSRVLLLLLLLLLVYLTQPGNGNEGSVTGSCYCGKRISSDSPPSVQFMNRLRKHLRAYHRCLYYTRFQLLSWSVCVEATRTHGFRN

SEQ ID NO: 849995 - protein, 54 aa, Homo sapiens
MACVNLHWEVMPSKKILIWGSGQNVDYFLMLCSKAYQLKREYQHLPSLGFEKWN

SEQ ID NO: 849996 - protein, 54 aa, Homo sapiens; identical to SEQ ID NO: 849995

SEQ ID NO: 849997 - protein, 54 aa, Homo sapiens; identical to SEQ ID NO: 849995

SEQ ID NO: 849998 - protein, 54 aa, Homo sapiens; identical to SEQ ID NO: 849995

SEQ ID NO: 849999 - protein, 1124 aa, Homo sapiens [sequence omitted]

SEQ ID NO: 850000 - protein, 1087 aa, Homo sapiens [sequence omitted]

SEQ ID NO: 850001 - protein, 1106 aa, Homo sapiens
MDPFTEKLLERTRARRENLQRKMAERPTAAPRSMTHAKRARQPLSEASNQQPLSGGEEKSCTKPSPSKKRCSDNTEVEVSNLENKQPVESTSAKSCSPSPVSPQVQPQAADTISDSVAVPASLLGMRRGLNSRLEATAASSVKTRMQKLAEQRRRWDNDDMTDDIPESSLFSPMPSEEKAASPPKPLLSNASATPVGRRGRLANLAATICSWEDDVNHSFAKQNSVQEQPGTACLSKFSSASGASARINSSSVKQEATFCSQRDGDASLNKALSSSADDASLVNASISSSVKATSPVKSTTSITDAKSCEGQNPELLPKTPISPLKTGVSKPIVKSTLSQTVPSKGELSREICLQSQSKDKSTTPGGTGIKPFLERFGERCQEHSKESPARSTPHRTPIITPNTKAIQERLFKQDTSSSTTHLAQQLKQERQKELACLRGRFDKGNIWSAEKGGNSKSKQLETKQETHCQSTPLKKHQGVSKTQSLPVTEKVTENQIPAKNSSTEPKGFTECEMTKSSPLKITLFLEEDKSLKVHQTHDDINSSKVINDLFSDVLEEGELDMEKSQEEMDQALAESSEEQEDALNISSMSLLAPLAQTVGVVSPESLVSTPRLELKDTSRSDESPKPGKFQRTRVPRAESGDSLGSEDRDLLYSIDAYRSQRFKETERPSIKQVIVRKEDVTSKLDEKNNAFPCQVNIKQKMQELNNEINMQQTVIYQASQALNCCVDEEHGKGSLEEAEAERLLLIATGKRTLLIDELNKLKNEGPQRKNKASPQSEFMPSKGSVTLSEIRLPLKADFVCSTVQKPDAANYYYLIILKAGAENMVATPLASTSNSLNGDALTFTTTFTLQDVSNDFEINIEVYSLVQKKDPSGLDKKKKTSKSKAITPKRLLTSITTKSNIHSSVMASPGGLSAVRTSNFALVGSYTLSLSSVGNTKFVLDKVPFLSSLEGHIYLKIKCQVNSSVEERGFLTIFEDVSGFGAWHRRWCVLSGNCISYWTYPDDEKRKNPIGRINLANCTSRQIEPANREFCARRNTFELITVRPQREDDRETLVSQCRDTLCVTKNWLSADTKEERDLWMQKLNQVLVDIRLWQPDACYKPIGKP

SEQ ID NO: 850002 - protein, 611 aa, Homo sapiens
MTKSSPLKITLFLEEDKSLKVTSDPKVEQKIEVIREIEMSVDDDDINSSKVINDLFSDVLEEGELDMEKSQEEMDQALAESSEEQEDALNISSMSLLAPLAQTVGVVSPESLVSTPRLELKDTSRSDESPKPGKFQRTRVPRAESGDSLGSEDRDLLYSIDAYRSQRFKETERPSIKQVIVRKEDVTSKLDEKNNAFPCQVNIKQKMQELNNEINMQQTVIYQASQALNCCVDEEHGKGSLEEAEAERLLLIATGKRTLLIDELNKLKNEGPQRKNKASPQSEFMPSKGSVTLSEIRLPLKADFVCSTVQKPDAANYYYLIILKAGAENMVATPLASTSNSLNGDALTFTTTFTLQDVSNDFEINIEVYSLVQKKDPSGLDKKKKTSKSKAITPKRLLTSITTKSNIHSSVMASPGGLSAVRTSNFALVGSYTLSLSSVGNTKFVLDKVPFLSSLEGHIYLKIKCQVNSSVEERGFLTIFEDVSGFGAWHRRWCVLSGNCISYWTYPDDEKRKNPIGRINLANCTSRQIEPANREFCARRNTFELITVRPQREDDRETLVSQCRDTLCVTKNWLSADTKEERDLWMQKLNQVLVDIRLWQPDACYKPIGKP

SEQ ID NO: 850003 - protein, 1092 aa, Homo sapiens
MDPFTEKLLERTRARRENLQRKMAERPTAAPRSMTHAKRARQPLSEASNQQPLSGGEEKSCTKPSPSKKRCSDNTEVEVSNLENKQPVESTSAKSCSPSPVSPQVQPQAADTISDSVAVPASLLGMRRGLNSRLEATAASSVKTRMQKLAEQRRRWDNDDMTDDIPESSLFSPMPSEEKAASPPKPLLSNASATPVGRRGRLANLAATICSWEDDVNHSFAKQNSVQEQPGTACLSKFSSASGASARINSSSVKQEATFCSQRDGDASLNKALSSSADDASLVNASISSSVKATSPVKSTTSITDAKSCEGQNPELLPKTPISPLKTGVSKPIVKSTLSQTVPSKGELSREICLQSQSKDKSTTPGGTGIKPFLERFGERCQEHSKESPARSTPHRTPIITPNTKAIQERLFKQDTSSSTTHLAQQLKQERQKELACLRGRFDKGNIWSAEKGGNSKSKQLETKQETHCQSTPLKKHQGVSKTQSLPVTEKVTENQIPAKNSSTEPKGFTECEMTKSSPLKITLFLEEDKSLKVTSDPKVEQKIEVIREIEMSVDDDDINSSKVINDLFSDVLEEGELDMEKSQEEMDQALAESSEEQEDALNISSMSLLAPLAQTVGVVSPESLVSTPRLELKDTSRSDESPKPGKFQRTRVPRAESGDSLGSEDRDLLYSIDAYRSQRFKETERPSIKQVIVRKEDVTSKLDEKNNAFPCQVNIKQKMQELNNEINMQQTVIYQASQALNCCVDEEHGKGSLEEAEAERLLLIATGKRTLLIDELNKLKNEGPQRKNKASPQSEFMPSKGSVTLSEIRLPLKADFVCSTVQKPDAANYYYLIILKAGAENMVATPLASTSNSLNGDALTFTTTFTLQDVSNDFEINIEVYSLVQKKDPSGLDKKKKTSKSKAITPKRLLTSITTKSNIHSSVMASPGGLSAVRTSNFALVGSYTLSLSSVGNTKFVLDKVPFLSSLEGHIYLKIKCQVNSSVEERGFLTIFEDVSGFGAWHRRWCVLSGNCISYWTYPDDEKRKNPIGRINLANCTSRQIEPANREFCARRNTFELITVRPQREDDRETLVSQCRDTLCVTKNWLACRYL

SEQ ID NO: 850004 - protein, 638 aa, Homo sapiens
MDPFTEKLLERTRARRENLQRKMAERPTAAPRSMTHAKRARQPLSEASNQQPLSGGEEKSCTKPSPSKKRCSDNTEVEVSNLENKQPVESTSAKSCSPSPVSPQVQPQAADTISDSVAVPASLLGMRRGLNSRLEATAASSVKTRMQKLAEQRRRWDNDDMTDDIPESSLFSPMPSEEKAASPPKPLLSNASATPVGRRGRLANLAATICSWEDDVNHSFAKQNSVQEQPGTACLSKFSSASGASARINSSSVKQEATFCSQRDGDASLNKALSSSADDASLVNASISSSVKATSPVKSTTSITDAKSCEGQNPELLPKTPISPLKTGVSKPIVKSTLSQTVPSKGELSREICLQSQSKDKSTTPGGTGIKPFLERFGERCQEHSKESPARSTPHRTPIITPNTKAIQERLFKQQDVSNDFEINIEVYSLVQKKDPSGLDKKKKTSKSKAITPKRLLTSITTKSNIHSSVMASPGGLSAVRTSNFALVGSYTLSLSSVGNTKFVLDKVPFLSSLEGHIYLKIKCQVNSSVEERGFLTIFEDVSGFGAWHRRWCVLSGNCISYWTYPDDEKRKNPIGRINLANCTSRQIEPANREFCARRNTFELITVRPQREDDRETLVSQCRDTLCVTKNWLACRYL

SEQ ID NO: 850005 - protein, 1124 aa, Homo sapiens [sequence omitted]

SEQ ID NO: 850006 - protein, 1106 aa, Homo sapiens
MDPFTEKLLERTRARRENLQRKMAERPTAAPRSMTHAKRARQPLSEASNQQPLSGGEEKSCTKPSPSKKRCSDNTEVEVSNLENKQPVESTSAKSCSPSPVSPQVQPQAADTISDSVAVPASLLGMRRGLNSRLEATAASSVKTRMQKLAEQRRRWDNDDMTDDIPESSLFSPMPSEEKAASPPKPLLSNASATPVGRRGRLANLAATICSWEDDVNHSFAKQNSVQEQPGTACLSKFSSASGASARINSSSVKQEATFCSQRDGDASLNKALSSSADDASLVNASISSSVKATSPVKSTTSITDAKSCEGQNPELLPKTPISLPSKGELSREICLQSQSKDKSTTPGGTGIKPFLERFGERCQEHSKESPARSTPHRTPIITPNTKAIQERLFKQDTSSSTTHLAQQLKQERQKELACLRGRFDKGNIWSAEKGGNSKSKQLETKQETHCQSTPLKKHQGVSKTQSLPVTEKVTENQIPAKNSSTEPKGFTECEMTKSSPLKITLFLEEDKSLKVTSDPKVEQKIEVIREIEMSVDDDDINSSKVINDLFSDVLEEGELDMEKSQEEMDQALAESSEEQEDALNISSMSLLAPLAQTVGVVSPESLVSTPRLELKDTSRSDESPKPGKFQRTRVPRAESGDSLGSEDRDLLYSIDAYRSQRFKETERPSIKQVIVRKEDVTSKLDEKNNAFPCQVNIKQKMQELNNEINMQQTVIYQASQALNCCVDEEHGKGSLEEAEAERLLLIATGKRTLLIDELNKLKNEGPQRKNKASPQSEFMPSKGSVTLSEIRLPLKADFVCSTVQKPDAANYYYLIILKAGAENMVATPLASTSNSLNGDALTFTTTFTLQDVSNDFEINIEVYSLVQKKDPSGLDKKKKTSKSKAITPKRLLTSITTKSNIHSSVMASPGGLSAVRTSNFALVGSYTLSLSSVGNTKFVLDKVPFLSSLEGHIYLKIKCQVNSSVEERGFLTIFEDVSGFGAWHRRWCVLSGNCISYWTYPDDEKRKNPIGRINLANCTSRQIEPANREFCARRNTFELITVRPQREDDRETLVSQCRDTLCVTKNWLSADTKEERDLWMQKLNQVLVDIRLWQPDACYKPIGKP

SEQ ID NO: 850007 - protein, 233 aa, Homo sapiens
VLDKKKNNIQVQGYYSKAILTSITTKSNIHSSVMASPGGLSAVRTSNFALVGSYTLSLSSVGNTKFVLDKVPFLSSLEGHIYLKIKCQVNSSVEERGFLTIFEDVSGFGAWHRRWCVLSGNCISYWTYPDDEKRKNPIGRINLANCTSRQIEPANREFCARRNTFELITVRPQREDDRETLVSQCRDTLCVTKNWLSADTKEERDLWMQKLNQVLVDIRLWQPDACYKPIGKP

SEQ ID NO: 850008 - protein, 438 aa, Homo sapiens
MDPFTEKLLERTRARRENLQRKMAERPTAAPRSMTHAKRARQPLSEASNQQPLSGGEEKSCTKPSPSKKRCSDNTEVEVSNLENKQPVESTSAKSCSPSPVSPQVQPQAADTISDSVAVPASLLGMRRGLNSRLEATAASSVKTRMQKLAEQRRRWDNDDMTDDIPESSLFSPMPSEEKAASPPKPLLSNASATPVGRRGRLANLAATICSWEDDVNHSFAKQNSVQEQPGTACLSKFSSASGASARINSSSVKQEATFCSQRDGDASLNKALSSSADDASLVNASISSSVKATSPVKSTTSITDAKSCEGQNPELLPKTPISPLKTGVSKPIVKSTLSQTVPSKGELSREICLQSQSKDKSTTPGGTGIKPFLERFGERCQEHSKESPARSTPHRTPIITPNTKAIQERLFKQDTSSSTTHLAQQLKQNVNNKAETH

SEQ ID NO: 850009 - protein, 186 aa, Homo sapiens
MLALISRLLDWFRSLFWKEEMELTLVGLQYSGKTTFVNVIASGQFSEDMIPTVGFNMRKVTKGNVTIKIWDIGGQPRFRSMWERYCRGVNAIVYMIDAADREKIEASRNELHNLLDKPQLQGIPVLVLGNKRDLPNALDEKQLIEKMNLSAIQDREICCYSISCKEKDNIDITLQWLIQHSKSRRS

SEQ ID NO: 850010 - protein, 186 aa, Homo sapiens; identical to SEQ ID NO: 850009

SEQ ID NO: 850011 - protein, 136 aa, Homo sapiens
MPAAGGPGRIGRAALAVGADGGAGTGVGGRASHMIRSASWVWLLPPAGVRPCRAGAPRSRWRVRAEARSCGSRRRRRSSVLPSVLAPGRHHAGAHLPPAGLVPFALLEGRDGADARGAAVLGQDHLRQCHRVRSIQ

SEQ ID NO: 850012 - protein, 186 aa, Homo sapiens; identical to SEQ ID NO: 850009

SEQ ID NO: 850013 - protein, 318 aa, Homo sapiens
MPAAGGPGRIGRAALAVGADGGAGTGVGGRASHMIRSASWVWLLPPAGVRPCRAGAPRSRWRVRAEARSCGSRRRRRSSVLPSVLAPGRHHAGAHLPPAGLVPFALLEGRDGADARGAAVLGQDHLRQCHRDQESGKPNVLIKKLLECNNAFKMPVLEDISQVNGFFKFFKDISGQFSEDMIPTVGFNMRKVTKGNVTIKIWDIGGQPRFRSMWERYCRGVNAIVYMIDAADREKIEASRNELHNLLDKPQLQGIPVLVLGNKRDLPNALDEKQLIEKMNLSAIQDREICCYSISCKEKDNIDITLQWLIQHSKSRRS

SEQ ID NO: 850014 - protein, 186 aa, Homo sapiens; identical to SEQ ID NO: 850009

SEQ ID NO: 850015 - protein, 145 aa, Homo sapiens
YQPAPQLFVDPPAPWGRRLPSCPLCLLQALSTSALPRQPKSSGSQGPQGESLDKEAWALRSSTVSAGARRWSWDECVDRGDGWPPRAAPGWSSGSSRWLPLRQRSLGDPPAEGGWQELAREPPALSRWEAESQCWGTVAWADLEP

SEQ ID NO: 850016 - protein, 680 aa, Homo sapiens
MTSQGLSLQLRQGPAGLGPKKRAEPQLVETQNVRLIEVERSVSVGPQWALGRCPVQCECGSTVDPGLGGIPCSVSVDSQWARGWGCPMQCECGPVVGTRGCPRHLAIANPHFWENAMLVAEKAALQGQLQHLEGQLGSLQGRAQELLLQSQRAQEHSSRLQAEKSVLEIQGQELHRKLEVLEEEVRAARQSQEETRGQQQALLRDHKALAQLQRRQEAELEGLLVRHRDLKANMRALELAHRELQGRHEQLQAQRASVEAQEVALLAERERLMQDGHRQRGLEEELRRLQSEHDRAQMLLAELSRERGELQGERGELRGRLARLELERAQLEMQSQQLRESNQQLDLSACRLTTQCELLTQLRSAQEEENRQLLAEVQALSRENRELLERSLESRDHLHREQREYLDQLNALRREKQKLVEKIMDQYRVLEPVPLPRTKVPFPGTHAPGPELPSACGMRPWQAGSGGNSAQGSRWGEALSHSALGTPLGNDSDSAIQAPWGRPSPTAKDLVWDGRTPLRPCRNTKQMPTERALRYRNRRNVPSPHPSASDTVGTAGLGVQPSRHWSVSGGPRQPKSSGSQGPQGESLDKEAWALRSSTVSAGARRWSWDECVDRGDGWPPRAAPGWSSGSSRWLPLRQRSLGDPPAEGGWQELAREPPALSRWEAESQCWGTVAWADLEP

SEQ ID NO: 850017 - protein, 696 aa, Homo sapiens
LEEAERERREKEALQAELEKAVVRGKELGARLEHLQRELEQAALERQEFLREKESQHQRYQGLEQRLEAELQAAATSKEEALMELKTRALQLEEELFQLRQGPAGLGPKKRAEPQLVETQNVRLIEVERSNAMLVAEKAALQGQLQHLEGQLGSLQGRAQELLLQSQRAQEHSSRLQAEKSVLEIQGQELHRKLEVLEEEVRAARQSQEETRGQQQALLRDHKALAQLQRRQEAELEGLLVRHRDLKANMRALELAHRELQGRHEQLQAQRASVEAQEVALLAERERLMQDGHRQRGLEEELRRLQSEHDRAQMLLAELSRERGELQGERGELRGRLARLELERAQLEMQSQQLRESNQQLDLSACRLTTQCELLTQLRSAQEEENRQLLAEVQALSRENRELLERSLESRDHLHREQREYLDQLNALRREKQKLVEKIMDQYRVLEPVPLPRTKVPFPGTHAPGPELPSACGMRPWQAGSGGNSAQGSRWGEALSHSALGTPLGNDSDSAIQAPWGRPSPTAKDLVWDGRTPLRPCRNTKQMPTERALRYRNRRNVPSPHPSASDTVGTAGLGVQPSRHWSVSGGPRQPKSSGSQGPQGESLDKEAWALRSSTVSAGARRWSWDECVDRGDGWPPRAAPGWSSGSSRWLPLRQRSLGDPPAEGGWQELAREPPALSRWEAESQCWGTVAWADLEP

SEQ ID NO: 850018 - protein, 468 aa, Homo sapiens
GRLVLVGGLVQKARDGGPQALDLAPPALDSVLEASAECPQAPDSDPQEAESPLQAAAMDPQASDWSPQESGSPVETQESPEKAGRRSSLQSPASVAPPQGPGTKIQAPQLLGGETEGREAPQGELVPEAWGLRQEGPEHKPGPSEPSSVQLEEQEGPNQGLDLATGQAEAREHDQRLEGTVRDPAWQKPQQKSEGALEVQVWEGPIPGESLASGVAEQEALQGGGGTGPLPRHPCAGPRAPSACGMRPWQAGSGGNSAQGSRWGEALSHSALGTPLGNDSDSAIQAPWGRPSPTAKDLVWDGRTPLRPCRNTKQMPTERALRYRNRRNVPSPHPSASDTVGTAGLGVQPSRHWSVSGGPRQPKSSGSQGPQGESLDKEAWALRSSTVSAGARRWSWDECVDRGDGWPPRAAPGWSSGSSRWLPLRQRSLGDPPAEGGWQELAREPPALSRWEAESQCWGTVAWADLEP

SEQ ID NO: 850019 - protein, 659 aa, Homo sapiens
MTSQGLSLQLRQGPAGLGPKKRAEPQLVETQNVRLIEVERSVSVGPQWALGRCPVQCECGSTVDPGLGGIPCSVSVDSQWARGWGCPMQCECGPVVGTRGCPRHLAIANPHFWENAMLVAEKAALQGQLQHLEGQLGSLQGRAQELLLQSQRAQEHSSRLQAEKSVLEIQGQELHRKLEVLEEEVRAARQSQEETRGQQQALLRDHKALAQLQRRQEAELEGLLVRHRDLKANMRALELAHRELQGRHEQLQAQRASVEAQEVALLAERERLMQDGHRQRGLEEELRRLQSEHDRAQMLLAELSRERGELQGERGELRGRLARLELERAQLEMQSQQLRESNQQLDLSACRLTTQCELLTQLRSAQEEENRQLLAEVQALSRENRELLERSLESRDHLHREQREYLDQLNALRREKQKLVEKIMDQYRVLEPVPLPRTKVPFPGTHAPGPELPSACGMRPWQAGSGGNSAQGSRWGEALSHSALGTPLGNDSDSAIQAPWGRPSPTAKDLVWDGRTPLRPCRNTKQMPTERALRYRNRRNVPSPHPSASDTVGTAGLGVQPSRHWSVSGGPRQPKSSGSQGPQGESLDKEAWALRSSTVSAGARRWSWDECVDRGDGWPPRAAPGWSSGSSRWLPLRQRSLGDPAIGPDFEPGTVPAFV

SEQ ID NO: 850020 - protein, 71 aa, Homo sapiens
VASEFLREKEAAQRYQGLEQRLEAELQAAATSKEEALMELKTRALQLEEELFQVMPARLGAGGHATLPSIP

SEQ ID NO: 850021 - protein, 704 aa, Homo sapiens
MAGVAAHRAHPPFTAHMKNRGLREELEKAVVRGKELGARLEHLQRELEQAALERQEFLREKESQHQRYQGLEQRLEAELQAAATSKEEALMELKTRALQLEEELFQLRQGPAGLGPKKRAEPQLVETQNVRLIEVERSNAMLVAEKAALQGQLQHLEGQLGSLQGRAQELLLQSQRAQEHSSRLQAEKSVLEIQGQELHRKLEVLEEEVRAARQSQEETRGQQQALLRDHKALAQLQRRQEAELEGLLVRHRDLKANMRALELAHRELQGRHEQLQAQRASVEAQEVALLAERERLMQDGHRQRGLEEELRRLQSEHDRAQMLLAELSRERGELQGERGELRGRLARLELERAQLEMQSQQLRESNQQLDLSACRLTTQCELLTQLRSAQEEENRQLLAEVQALSRENRELLERSLESRDHLHREQREYLDQLNALRREKQKLVEKIMDQYRVLEPVPLPRTKVPFPGTHAPGPELPSACGMRPWQAGSGGNSAQGSRWGEALSHSALGTPLGNDSDSAIQAPWGRPSPTAKDLVWDGRTPLRPCRNTKQMPTERALRYRNRRNVPSPHPSASDTVGTAGLGVQPSRHWSVSGGPRQPKSSGSQGPQGESLDKEAWALRSSTVSAGARRWSWDECVDRGDGWPPRAAPGWSSGSSRWLPLRQRSLGDPPAEGGWQELAREPPALSRWEAESQCWGTVAWADLEP

SEQ ID NO: 850022 - protein, 314 aa, Homo sapiens
GTVRRSFGLEPVPLPRDKKGSWLADKVKRLMRPRREGGPPGGLRLGADGAGSTESLGGPPETELPEGREADGTGPLPRHPCAGPRAPSACGMRPWQAGSGGNSAQGSRWGEALSHSALGTPLGNDSDSAIQAPWGRPSPTAKDLVWDGRTPLRPCRNTKQMPTERALRYRNRRNVPSPHPSASDTVGTAGLGVQPSRHWSVSGGPRQPKSSGSQGPQGESLDKEAWALRSSTVSAGARRWSWDECVDRGDGWPPRAAPGWSSGSSRWLPLRQRSLGDPPAEGGWQELAREPPALSRWEAESQCWGTVAWADLEP

SEQ ID NO: 850023 - protein, 446 aa, Homo sapiens
MTSQGLSLQLRQGPAGLGPKKRAEPQLVETQNVRLIEVERSVSVGPQWALGRCPVQCECGSTVDPGLGGIPCSVSVDSQWARGWGCPMQCECGPVVGTRGCPRHLAIANPHFWENAMLVAEKAALQGQLQHLEGQLGSLQGRAQELLLQSQRAQEHSSRLQAEKSVLEIQGQELHRKLEVLEEEVRAARQSQEETRGQQQALLRDHKALAQLQRRQEAELEGLLVRHRDLKANMRALELAHRELQGRHEQLQAQRASVEAQEVALLAERERLMQDGHRQRGLEEELRRLQSEHDRAQMLLAELSRERGELQGERGELRGRLARLELERAQLEMQSQQLRESNQQLDLSACRLTTQCELLTQLRSAQEEENRQLLAEVQALSRENRELLERSLESRDHLHREQREYLDQLNALRREKQKLVEKIMDQYRVLEPVPLPRTKKGSLAVT

SEQ ID NO: 850024 - protein, 2715 aa, Homo sapiens
MAAAAGGGSCPGPGSARGRFPGRPRGAGGGGGRGGRGNGAERVRVALRRGGGATGPGGAEPGEDTALLRLLGLRRGLRRLRRLWAGPRVQRGRGRGRGRGWGPSRGCVPEEESSDGESDEEEFQGFHSDEDVAPSSLRSALRSQRGRAPRGRGRKHKTTPLPPPRLADVAPTPPKTPARKRGEEGTERMVQALTELLRRAQAPQAPRSRACEPSTPRRSRGRPPGRPAGPCRRKQQAVVVAEAAVTIPKPEPPPPVVPVKHQTGSWKCKEGPGPGPGTPRRGGQSSRGGRGGRGRGRGGGLPFVIKFVSRAKKVKMGQLSLGLESGQGQGQHEESWQDVPQRRVGSGQGGSPCWKKQEQKLDDEEEEKKEEEEKDKEGEEKEERAVAEEMMPAAEKEEAKLPPPPLTPPAPSPPPPLPPPSTSPPPPLCPPPPPPVSPPPLPSPPPPPAQEEQEESPPPVVPATCSRKRGRPPLTPSQRAEREAARAGPEGTSPPTPTPSTATGGPPEDSPTVAPKSTTFLKNIRQFIMPVVSARSSRVIKTPRRFMDEDPPKPPKVEVSPVLRPPITTSPPVPQEPAPVPSPPRAPTPPSTPVPLPEKRRSILREPTFRWTSLTRELPPPPPAPPPPPAPSPPPAPATSSRRPLLLRAPQFTPSEAHLKIYESVLTPPPLGAPEAPEPEPPPADDSPAEPEPRAVGRTNHLSLPRFAPVVTTPVKAEVSPHGAPALSNGPQTQAQLLQPLQALQTQLLPQALPPPQPQLQPPPSPQQMPPLEKARIAGVGSLPLSGVEEKMFSLLKRAKVQLFKIDQQQQQKVAASMPLSPGGQMEEVAGAVKQISDRGPVRSEDESVEAKRERPSGPESPVQGPRIKHVCRHAAVALGQARAMVPEDVPRLSALPLRDRQDLATEDTSSASETESVPSRSRRGKVEAAGPGGESEPTGSGGTLAHTPRRSLPSHHGKKMRMARCGHCRGCLRVQDCGSCVNCLDKPKFGGPNTKKQCCVYRKCDKIEARKMERLAKKGRTIVKTLLPWDSDESPEASPGPPGPRRGAGAGGPREEVVAHPGPEEQDSLLQRKSARRCVKQRPSYDIFEDSDDSEPGGPPAPRRRTPRENELPLPEPEEQSRPRKPTLQPVLQLKARRRLDKDALAPGPFASFPNGWTGKQKSPDGVHRVRVDFKEDCDLENVWLMGGLSVLTSVPGGPPMVCLLCASKGLHELVFCQVCCDPFHPFCLEEAERPLPQHHDTWCCRRCKFCHVCGRKGRGSKHLLECERCRHAYHPACLGPSYPTRATRKRRHWICSACVRCKSCGATPGKNWDVEWSGDYSLCPRCTQLYEKGNYCPICTRCYEDNDYESKMMQCAQCDHWVHAKCEGLSDEDYEILSGLPDSVLYTCGPCAGAAQPRWREALSGALQGGLRQVLQGLLSSKVVGPLLLCTQCGPDGKQLHPGPCGLQAVSQRFEDGHYKSVHSFMEDMVGILMRHSEEGETPDRRAGGQMKGLLLKLLESAFGWFDAHDPKYWRRSTRLPNGVLPNAVLPPSLDHVYAQWRQQEPETPESGQPPGDPSAAFQGKDPAAFSHLEDPRQCALCLKYGDADSKEAGRLLYIGQNEWTHVNCAIWSAEVFEENDGSLKNVHAAVARGRQMRCELCLKPGATVGCCLSSCLSNFHFMCARASYCIFQDDKKVFCQKHTDLLDGKEIVNPDGFDVLRRVYVDFEGINFKRKFLTGLEPDAINVLIGSIRIDSLGTLSDLSDCEGRLFPIGYQCSRLYWSTVDARRRCWYRCRILEYRPWGPREEPAHLEAAEENQTIVHSPAPSSEPPGGEDPPLDTDVLVPGAPERHSPIQNLDPPLRPDSGSAPPPAPRSFSGARIKVPNYSPSRRPLGGVSFGPLPSPGSPSSLTHHIPTVGDPDFPAPPRRSRRPSPLAPRPPPSRWASPPLKTSPQLRVPPPTSVVTALTPTSGELAPPGPAPSPPPPEDLGPDFEDMEVVSGLSAADLDFAASLLGTEPFQEEIVAAGAMGSSHGGPGDSSEEESSPTSRYIHFPVTVVSAPGLAPSATPGAPRIEQLDGVDDGTDSEAEAVQQPRGQGTPPSGPGVVRAGVLGAAGDRARPPEDLPSEIVDFVLKNLGGPGDGGAGPREESLPPAPPLANGSQPSQGLTASPADPTRTFAWLPGAPGVRVLSLGPAPEPPKPATSKIILVNKLGQVFVKMAGEGEPVPPPVKQPPLPPTISPTAPTSWTLPPGPLLGVLPVVGVVRPAPPPPPPPLTLVLSSGPASPPRQAIRVKRVSTFSGRSPPAPPPYKAPRLDEDGEASEDTPQVPGLGSGGFSRVRMKTPTVRGVLDLDRPGEPAGEESPGPLQERSPLLPLPEDGPPQVPDGPPDLLLESQWHHYSGEASSSEEEPPSPDDKENQAPKRTGPHLRFEISSEDGFSVEAESLEGAWRTLIEKVQEARGHARLRHLSFSGMSGARLLGIHHDAVIFLAEQLPGAQRCQHYKFRYHQQGEGQEEPPLNPHGAARAEVYLRKCTFDMFNFLASQHRVLPEGATCDEEEDEVQLRSTRRATSLELPMAMRFRHLKKTSKEAVGVYRSAIHGRGLFCKRNIDAGEMVIEYSGIVIRSVLTDKREKFYDGKGIGCYMFRMDDFDVVDATMHGNAARFINHSCEPNCFSRVIHVEGQKHIVIFALRRILRGEELTYDYKFPIEDASNKLPCNCGAKRCRRFLN

SEQ ID NO: 850025 - protein, 257 aa, Homo sapiens
MSGARLLGIHHDAVIFLAEQLPGAQRCQHYKFRYHQQGEGQEEPPLNPHGAARAEVYLRKCTFDMFNFLASQHRVLPEGATCDEEEDEVQLRSTRRATSLELPMAMRFRHLKKTSKEAVGVYRSAIHGRGLFCKRNIDAGEMVIEYSGIVIRSVLTDKREKFYDGKGIGCYMFRMDDFDVVDATMHGNAARFINHSCEPNCFSRVIHVEGQKHIVIFALRRILRGEELTYDYKFPIEDASNKLPCNCGAKRCRRFLN

SEQ ID NO: 850026 - protein, 2571 aa, Homo sapiens
MAAAAGGGSCPGPGSARGRFPGRPRGAGGGGGRGGRGNGAERVRVALRRGGGATGPGGAEPGEDTALLRLLGLRRGLRRLRRLWAGPRVQRGRGRGRGRGWGPSRGCVPEEESSDGESDEEEFQGFHSDEDVAPSSLRSALRSQRGRAPRGRGRKHKTTPLPPPRLADVAPTPPKTPARKRGEEGTERMVQALTELLRRAQAPQAPRSRACEPSTPRRSRGRPPGRPAGPCRRKQQAVVVAEAAVTIPKPEPPPPVVPVKHQTGSWKCKEGPGPGPGTPRRGGQSSRGGRGGRGRGRGGGLPFVIKFVSRAKKVKMGQLSLGLESGQGQGQHEESWQDVPQRRVGSGQGGSPCWKKQEQKLDDEEEEKKEEEEKDKEGEEKEERAVAEEMMPAAEKEEAKLPPPPLTPPAPSPPPPLPPPSTSPPPPLCPPPPPPVSPPPLPSPPPPPAQEEQEESPPPVVPATCSRKRGRPPLTPSQRAEREAARAGPEGTSPPTPTPSTATGGPPEDSPTVAPKKHHLPEEYPAVYYACAPEPEPPPADDSPAEPEPRAVGRTNHLSLPRFAPVVTTPVKAEVSPHGAPALSNGPQTQAQLLQPLQALQTQLLPQALPPPQPQLQPPPSPQQMPPLEKARIAGVGSLPLSGVEEKMFSLLKRAKVQLFKIDQQQQQKVAASMPLSPGGQMEEVAGAVKQISDRGPVRSEDESVEAKRERPSGPESPVQGPRIKHVCRHAAVALGQARAMVPEDVPRLSALPLRDRQDLATEDTSSASETESVPSRSRRGKVEAAGPGGESEPTGSGGTLAHTPRRSLPSHHGKKMRMARCGHCRGCLRVQDCGSCVNCLDKPKFGGPNTKKQCCVYRKCDKIEARKMERLAKKGRTIVKTLLPWDSDESPEASPGPPGPRRGAGAGGPREEVVAHPGPEEQDSLLQRKSARRCVKQRPSYDIFEDSDDSEPGGPPAPRRRTPRENELPLPEPEEQSRPRKPTLQPVLQLKARRRLDKDALAPGPFASFPNGWTGKQKSPDGVHRVRVDFKEDCDLENVWLMGGLSVLTSVPGGPPMVCLLCASKGLHELVFCQVCCDPFHPFCLEEAERPLPQHHDTWCCRRCKFCHVCGRKGRGSKHLLECERCRHAYHPACLGPSYPTRATRKRRHWICSACVRCKSCGATPGKNWDVEWSGDYSLCPRCTQLYEKGNYCPICTRCYEDNDYESKMMQCAQCDHWVHAKCEGLSDEDYEILSGLPDSVLYTCGPCAGAAQPRWREALSGALQGGLRQVLQGLLSSKVVGPLLLCTQCGPDGKQLHPGPCGLQAVSQRFEDGHYKSVHSFMEDMVGILMRHSEEGETPDRRAGGQMKGLLLKLLESAFGWFDAHDPKYWRRSTRLPNGVLPNAVLPPSLDHVYAQWRQQEPETPESGQPPGDPSAAFQGKDPAAFSHLEDPRQCALCLKYGDADSKEAGRLLYIGQNEWTHVNCAIWSAEVFEENDGSLKNVHAAVARGRQMRCELCLKPGATVGCCLSSCLSNFHFMCARASYCIFQDDKKVFCQKHTDLLDGKEIVNPDGFDVLRRVYVDFEGINFKRKFLTGLEPDAINVLIGSIRIDSLGTLSDLSDCEGRLFPIGYQCSRLYWSTVDARRRCWYRCRILEYRPWGPREEPAHLEAAEENQTIVHSPAPSSEPPGGEDPPLDTDVLVPGAPERHSPIQNLDPPLRPDSGSAPPPAPRSFSGARIKVPNYSPSRRPLGGVSFGPLPSPGSPSSLTHHIPTVGDPDFPAPPRRSRRPSPLAPRPPPSRWASPPLKTSPQLRVPPPTSVVTALTPTSGELAPPGPAPSPPPPEDLGPDFEDMEVVSGLSAADLDFAASLLGTEPFQEEIVAAGAMGSSHGGPGDSSEEESSPTSRYIHFPVTVVSAPGLAPSATPGAPRIEQLDGVDDGTDSEAEAVQQPRGQGTPPSGPGVVRAGVLGAAGDRARPPEDLPSEIVDFVLKNLGGPGDGGAGPREESLPPAPPLANGSQPSQGLTASPADPTRTFAWLPGAPGVRVLSLGPAPEPPKPATSKIILVNKLGQVFVKMAGEGEPVPPPVKQPPLPPTISPTAPTSWTLPPGPLLGVLPVVGVVRPAPPPPPPPLTLVLSSGPASPPRQAIRVKRVSTFSGRSPPAPPPYKAPRLDEDGEASEDTPQVPGLGSGGFSRVRMKTPTVRGVLDLDRPGEPAGEESPGPLQERSPLLPLPEDGPPQVPDGPPDLLLESQWHHYSGEASSSEEEPPSPDDKENQAPKRTGPHLRFEISSEDGFSVEAESLEGAWRTLIEKVQEARGHARLRHLSFSGMSGARLLGIHHDAVIFLAEQLPGAQRCQHYKFRYHQQGEGQEEPPLNPHGAARAEVYLRKCTFDMFNFLASQHRVLPEGATCDEEEDEVQLRSTRRATSLELPMAMRFRHLKKTSKEAVGVYRSAIHGRGLFCKRNIDAGEMVIEYSGIVIRSVLTDKREKFYDGKGIGCYMFRMDDFDVVDATMHGNAARFINHSCEPNCFSRVIHVEGQKHIVIFALRRILRGEELTYDYKFPIEDASNKLPCNCGAKRCRRFLN

SEQ ID NO: 850027 - protein, 2715 aa, Homo sapiens; identical to SEQ ID NO: 850024

SEQ ID NO: 850028 - protein, 2715 aa, Homo sapiens; identical to SEQ ID NO: 850024

SEQ ID NO: 850029 - protein, 67 aa, Homo sapiens
VWAQGLARVGGGLKVRASLCQQVSPSLSPHPTAPPGVRALPPCIPPGLSGAQLSNPGHAQTAPLGER

SEQ ID NO: 850030 - protein, 112 aa, Homo sapiens
VGEASLSAGTEHLISPPPSLQGIGCYMFRMDDFDVVDATMHGNAARFINHSCEPNCFSRVIHVEGQKHIVIFALRRILRGEELTYDYKFPIEDASNKLPCNCGAKRCRRFLN

SEQ ID NO: 850031 - protein, 2661 aa, Homo sapiens
MAAAAGGGSCPGPGSARGRFPGRPRGAGGGGGRGGRGNGAERVRVALRRGGGATGPGGAEPGEDTALLRLLGLRRGLRRLRRLWAGPRVQRGRGRGRGRGWGPSRGCVPEEESSDGESDEEEFQGFHSDEDVAPSSLRSALRSQRGRAPRGRGRKHKTTPLPPPRLADVAPTPPKTPARKRGEEGTERMVQALTELLRRAQAPQAPRSRACEPSTPRRSRGRPPGRPAGPCRRKQQAVVVAEAAVTIPFVIKFVSRAKKVKMGQLSLGLESGQGQGQHEESWQDVPQRRVGSGQGGSPCWKKQEQKLDDEEEEKKEEEEKDKEGEEKEERAVAEEMMPAAEKEEAKLPPPPLTPPAPSPPPPLPPPSTSPPPPLCPPPPPPVSPPPLPSPPPPPAQEEQEESPPPVVPATCSRKRGRPPLTPSQRAEREAARAGPEGTSPPTPTPSTATGGPPEDSPTVAPKSTTFLKNIRQFIMPVVSARSSRVIKTPRRFMDEDPPKPPKVEVSPVLRPPITTSPPVPQEPAPVPSPPRAPTPPSTPVPLPEKRRSILREPTFRWTSLTRELPPPPPAPPPPPAPSPPPAPATSSRRPLLLRAPQFTPSEAHLKIYESVLTPPPLGAPEAPEPEPPPADDSPAEPEPRAVGRTNHLSLPRFAPVVTTPVKAEVSPHGAPALSNGPQTQAQLLQPLQALQTQLLPQALPPPQPQLQPPPSPQQMPPLEKARIAGVGSLPLSGVEEKMFSLLKRAKVQLFKIDQQQQQKVAASMPLSPGGQMEEVAGAVKQISDRGPVRSEDESVEAKRERPSGPESPVQGPRIKHVCRHAAVALGQARAMVPEDVPRLSALPLRDRQDLATEDTSSASETESVPSRSRRGKVEAAGPGGESEPTGSGGTLAHTPRRSLPSHHGKKMRMARCGHCRGCLRVQDCGSCVNCLDKPKFGGPNTKKQCCVYRKCDKIEARKMERLAKKGRTIVKTLLPWDSDESPEASPGPPGPRRGAGAGGPREEVVAHPGPEEQDSLLQRKSARRCVKQRPSYDIFEDSDDSEPGGPPAPRRRTPRENELPLPEPEEQSRPRKPTLQPVLQLKARRRLDKDALAPGPFASFPNGWTGKQKSPDGVHRVRVDFKEDCDLENVWLMGGLSVLTSVPGGPPMVCLLCASKGLHELVFCQVCCDPFHPFCLEEAERPLPQHHDTWCCRRCKFCHVCGRKGRGSKHLLECERCRHAYHPACLGPSYPTRATRKRRHWICSACVRCKSCGATPGKNWDVEWSGDYSLCPRCTQLYEKGNYCPICTRCYEDNDYESKMMQCAQCDHWVHAKCEGLSDEDYEILSGLPDSVLYTCGPCAGAAQPRWREALSGALQGGLRQVLQGLLSSKVVGPLLLCTQCGPDGKQLHPGPCGLQAVSQRFEDGHYKSVHSFMEDMVGILMRHSEEGETPDRRAGGQMKGLLLKLLESAFGWFDAHDPKYWRRSTRLPNGVLPNAVLPPSLDHVYAQWRQQEPETPESGQPPGDPSAAFQGKDPAAFSHLEDPRQCALCLKYGDADSKEAGRLLYIGQNEWTHVNCAIWSAEVFEENDGSLKNVHAAVARGRQMRCELCLKPGATVGCCLSSCLSNFHFMCARASYCIFQDDKKVFCQKHTDLLDGKEIVNPDGFDVLRRVYVDFEGINFKRKFLTGLEPDAINVLIGSIRIDSLGTLSDLSDCEGRLFPIGYQCSRLYWSTVDARRRCWYRCRILEYRPWGPREEPAHLEAAEENQTIVHSPAPSSEPPGGEDPPLDTDVLVPGAPERHSPIQNLDPPLRPDSGSAPPPAPRSFSGARIKVPNYSPSRRPLGGVSFGPLPSPGSPSSLTHHIPTVGDPDFPAPPRRSRRPSPLAPRPPPSRWASPPLKTSPQLRVPPPTSVVTALTPTSGELAPPGPAPSPPPPEDLGPDFEDMEVVSGLSAADLDFAASLLGTEPFQEEIVAAGAMGSSHGGPGDSSEEESSPTSRYIHFPVTVVSAPGLAPSATPGAPRIEQLDGVDDGTDSEAEAVQQPRGQGTPPSGPGVVRAGVLGAAGDRARPPEDLPSEIVDFVLKNLGGPGDGGAGPREESLPPAPPLANGSQPSQGLTASPADPTRTFAWLPGAPGVRVLSLGPAPEPPKPATSKIILVNKLGQVFVKMAGEGEPVPPPVKQPPLPPTISPTAPTSWTLPPGPLLGVLPVVGVVRPAPPPPPPPLTLVLSSGPASPPRQAIRVKRVSTFSGRSPPAPPPYKAPRLDEDGEASEDTPQVPGLGSGGFSRVRMKTPTVRGVLDLDRPGEPAGEESPGPLQERSPLLPLPEDGPPQVPDGPPDLLLESQWHHYSGEASSSEEEPPSPDDKENQAPKRTGPHLRFEISSEDGFSVEAESLEGAWRTLIEKVQEARGHARLRHLSFSGMSGARLLGIHHDAVIFLAEQLPGAQRCQHYKFRYHQQGEGQEEPPLNPHGAARAEVYLRKCTFDMFNFLASQHRVLPEGATCDEEEDEVQLRSTRRATSLELPMAMRFRHLKKTSKEAVGVYRSAIHGRGLFCKRNIDAGEMVIEYSGIVIRSVLTDKREKFYDGKGIGCYMFRMDDFDVVDATMHGNAARFINHSCEPNCFSRVIHVEGQKHIVIFALRRILRGEELTYDYKFPIEDASNKLPCNCGAKRCRRFLN

SEQ ID NO: 850032 - protein, 2427 aa, Homo sapiens
MAAAAGGGSCPGPGSARGRFPGRPRGAGGGGGRGGRGNGAERVRVALRRGGGATGPGGAEPGEDTALLRLLGLRRGLRRLRRLWAGPRVQRGRGRGRGRGWGPSRGCVPEEESSDGESDEEEFQGFHSDEDVAPSSLRSALRSQRGRAPRGRGRKHKTTPLPPPRLADVAPTPPKTPARKRGEEGTERMVQALTELLRRAQAPQAPRSRACEPSTPRRSRGRPPGRPAGPCRRKQQAVVVAEAAVTIPKPEPPPPVVPVKHQTGSWKCKEGPGPGPGTPRRGGQSSRGGRGGRGRGRGGGLPFVIKFVSRAKKVKMGQLSLGLESGQGQGQHEESWQDVPQRRVGSGQGGSPCWKKQEQKLDDEEEEKKEEEEKDKEGEEKEERAVAEEMMPAAEKEEAKLPPPPLTPPAPSPPPPLPPPSTSPPPPLCPPPPPPVSPPPLPSPPPPPAQEEQEESPPPVVPATCSRKRGRPPLTPSQRAEREAARAGPEGTSPPTPTPSTATGGPPEDSPTVAPKSTTFLKNIRQFIMPVVSARSSRVIKTPRRFMDEDPPKPPKVEVSPVLRPPITTSPPVPQEPAPVPSPPRAPTPPSTPVPLPEKRRSILREPTFRWTSLTRELPPPPPAPPPPPAPSPPPAPATSSRRPLLLRAPQFTPSEAHLKIYESVLTPPPLGAPEAPEPEPPPADDSPAEPEPRAVGRTNHLSLPRFAPVVTTPVKAEVSPHGAPALSNGPQTQAQLLQPLQALQTQLLPQALPPPQPQLQPPPSPQQMPPLEKARIAGVGSLPLSGVEEKMFSLLKRAKVQLFKIDQQQQQKVAASMPLSPGGQMEEVAGAVKQISDRGPVRSEDESVEAKRERPSGPESPVQGPRIKHVCRHAAVALGQARAMVPEDVPRLSALPLRDRQDLATEDTSSASETESVPSRSRRGKVEAAGPGGESEPTGSGGTLAHTPRRSLPSHHGKKMRMARCGHCRGCLRVQDCGSCVNCLDKPKFGGPNTKKQCCVYRKCDKIEARKMERLAKKGRTIVKTLLPWDSDESPEASPGPPGPRRGAGAGGPREEVVAHPGPEEQDSLLQRKSARRCVKQRPSYDIFEDSDDSEPGGPPAPRRRTPRENELPLPEPEEQSRPRKPTLQPVLQLKARRRLDKDALAPGPFASFPNGWTGKQKSPDGVHRVRVDFKEDCDLENVWLMGGLSVLTSVPGGPPMVCLLCASKGLHELVFCQVCCDPFHPFCLEEAERPLPQHHDTWCCRRCKFCHVCGRKGRGSKHLLECERCRHAYHPACLGPSYPTRATRKRRHWICSACVRCKSCGATPGKNWDVEWSGDYSLCPRCTQLYEKGNYCPICTRCYEDNDYESKMMQCAQCDHWVHAKCEGLSDEDYEILSGLPDSVLYTCGPCAGAAQPRWREALSGALQGGLRQVLQGLLSSKVVGPLLLCTQCGPDGKQLHPGPCGLQAVSQRFEDGHYKSVHSFMEDMVGILMRHSEEGETPDRRAGGQMKGLLLKLLESAFGWFDAHDPKYWRRSTRLPNGVLPNAVLPPSLDHVYAQWRQQEPETPESGQPPGDPSAAFQGKDPAAFSHLEDPRQCALCLKYGDADSKEAGRLLYIGQNEWTHVNCAIWSAEVFEENDGSLKNVHAAVARGRQMRCELCLKPGATVGCCLSSCLSNFHFMCARASYCIFQDDKKVFCQKHTDLLDGKEIVNPDGFDVLRRVYVDFEGINFKRKFLTGLEPDAINVLIGSIRIDSLGTLSDLSDCEGRLFPIGYQCSRLYWSTVDARRRCWYRCRILEYRPWGPREEPAHLEAAEENQTIVHSPAPSSEPPGGEDPPLDTDVLVPGAPERHSPIQNLDPPLRPDSGSAPPPAPRSFSGARIKVPNYSPSRRPLGGVSFGPLPSPGSPSSLTHHIPTVGDPDFPAPPRRSRRPSPLAPRPPPSRWASPPLKTSPQLRVPPPTSVVTALTPTSGELAPPGPAPSPPPPPLTLVLSSGPASPPRQAIRVKRVSTFSGRSPPAPPPYKAPRLDEDGEASEDTPQVPGLGSGGFSRVRMKTPTVRGVLDLDRPGEPAGEESPGPLQERSPLLPLPEDGPPQVPDGPPDLLLESQWHHYSGEASSSEEEPPSPDDKENQAPKRTGPHLRFEISSEDGFSVEAESLEGAWRTLIEKVQEARGHARLRHLSFSGMSGARLLGIHHDAVIFLAEQLPGAQRCQHYKFRYHQQGEGQEEPPLNPHGAARAEVYLRKCTFDMFNFLASQHRVLPEGATCDEEEDEVQLRSTRRATSLELPMAMRFRHLKKTSKEAVGVYRSAIHGRGLFCKRNIDAGEMVIEYSGIVIRSVLTDKREKFYDGKGIGCYMFRMDDFDVVDATMHGNAARFINHSCEPNCFSRVIHVEGQKHIVIFALRRILRGEELTYDYKFPIEDASNKLPCNCGAKRCRRFLN

SEQ ID NO: 850033 - protein, 2715 aa, Homo sapiens; identical to SEQ ID NO: 850024

SEQ ID NO: 850034 - protein, 342 aa, Homo sapiens
GRVIFTPTCFLGPGEASSSEEEPPSPDDKENQAPKRTGPHLRFEISSEDGFSVEAESLEGAWRTLIEKVQEARGHARLRHLSFSGMSGARLLGIHHDAVIFLAEQLPGAQRCQHYKFRYHQQGEGQEEPPLNPHGAARAEVYLRKCTFDMFNFLASQHRVLPEGATCDEEEDEVQLRSTRRATSLELPMAMRFRHLKKTSKEAVGVYRSAIHGRGLFCKRNIDAGEMVIEYSGIVIRSVLTDKREKFYDGKGIGCYMFRMDDFDVVDATMHGNAARFINHSCEPNCFSRVIHVEGQKHIVIFALRRILRGEELTYDYKFPIEDASNKLPCNCGAKRCRRFLN

SEQ ID NO: 850035 - protein, 375 aa, Homo sapiens
YSAFPVMCFRFFYTTATLIIAFTSAGSAVLLFLAMPMLTIGGILFLITNLQIGNLFGQHRSTIITLYNGAFDSSSAVFLIIKLLYEKGISLRASFIFISVCSTWHVARTFLLMPRGHIPYPLPPNYSMACALGMAPQRKRRKQLSMKTGSYSQRSSFQRRKRPRGRAEAGTPLLLELRFLSALCLAPGVAVCDTVVALPLHWHSQLLAANMAGGDMARVSTYTNAFAFTQFGVLCAPWNGLLMDRLKQKYQKEARKTGSFNIRGPHSLYFPNHHLPHATYRDKAKMKLPLLLALLFGAVSALHLRSETSTFETPLGAKTLPEDEETPEQEMEETPCRELEEEEEWGSGSEDASKKDGAVESISVPDMVGQKPYVS

SEQ ID NO: 850036 - protein, 113 aa, Homo sapiens
NYQLTHVGRSKDPGRSLGWDKAKMKLPLLLALLFGAVSALHLRSETSTFETPLGAKTLPEDEETPEQEMEETPCRELEEEEEWGSGSEDASKKDGAVESISVPDMVGQKPYVS

SEQ ID NO: 850037 - protein, 105 aa, Homo sapiens
MRRHQSRRWRRPLAGSWRKRRSGALEVKMPPRKMGLLSLSQCQIWWDKNLTCPEEEDTVKVVGHPWGARPAATSWVRSLQTFSQAWFYLPEVLQGQPGFHPQLQY

SEQ ID NO: 850038 - protein, 164 aa, Homo sapiens
HPSCISSVDTFVDARGLGERAGCSHTWVCGWALHMRLMTGCGEQAQNDPVFLPRNPRRGSLADAFSGLTAAAGTLRTGLLTSPGPAVVTAWPCVPEEATGVEPTASEDFLSSVPTELVPASSSELPSPGQLPPLLCKEPTHFAPPGTVSSFVAKLFIFVSARNP

SEQ ID NO: 850039 - protein, 105 aa, Homo sapiens; identical to SEQ ID NO: 850037

SEQ ID NO: 850040 - protein, 154 aa, Homo sapiens
VRGSKEGPGLWEDLKTQEGLWVGECFLCCGGAGDSLFSQEVPGCGSQFLEGWQASTCGFQDKAKMKLPLLLALLFGAVSALHLRSETSTFETPLGAKTLPEDEETPEQEMEETPCRELEEEEEWGSGSEDASKKDGAVESISVPDMVGQKPYVS

SEQ ID NO: 850041 - protein, 123 aa, Homo sapiens
MKLPLLLAPLWVLRRCLRMRRHQSRRWRRPLAGSWRKRRSGALEVKMPPRKMGLLSLSQCQIWWDKNLTCPEEEDTVKVVGHPWGARPAATSWVRSLQTFSQAWFYLPEVLQGQPGFHPQLQY

SEQ ID NO: 850042 - protein, 218 aa, Homo sapiens
SVADSTTPQLPLPGQEGVLVPGLPPHHPELLDYGFSCSSDELPVLGLTKSGGSDRTIAYENKALMLCEGLFVADVTDFEGWKAAIPSALDTNSSKSTSSFPCPAGHFNGFRTVIRPFYLTNSSGVDKTAWPRGGENGRTPGRPHCRLPSRASFLSARNPRAWVACRRFQWVDGSRWNFAYWAAHQPWSRGGHCVALCTRGGYWRRAHCLRRLPFICSY

SEQ ID NO: 850043 - protein, 115 aa, Homo sapiens
HPSCISSVDTFVDARGLGERAGCSHTWVCGWALHMRLMTGCGEQAQNDPGFSAKEPPAWVACRRFQWVDGSRWNFAYWAAHQPWSRGGHCVALCTRGGYWRRAHCLRRLPFICSY

SEQ ID NO: 850044 - protein, 218 aa, Homo sapiens; identical to SEQ ID NO: 850042

SEQ ID NO: 850045 - protein, 105 aa, Homo sapiens; identical to SEQ ID NO: 850037

SEQ ID NO: 850046 - protein, 105 aa, Homo sapiens; identical to SEQ ID NO: 850037

SEQ ID NO: 850047 - protein, 105 aa, Homo sapiens; identical to SEQ ID NO: 850037

SEQ ID NO: 850048 - protein, 100 aa, Homo sapiens
GCAEVTLRIPRGSLADAFSGLTAAAGTLRTGLLTSPGPAVVTAWPCVPEEATGVEPTASEDFLSSVPTELVPASSSELPSPGQLPPLLCKEPTRDPLDRN

SEQ ID NO: 850049 - protein, 105 aa, Homo sapiens; identical to SEQ ID NO: 850037

SEQ ID NO: 850050 - protein, 105 aa, Homo sapiens; identical to SEQ ID NO: 850037

SEQ ID NO: 850051 - protein, 109 aa, Homo sapiens
IFTLIKGSLQNDPFYDKAKMKLPLLLALLFGAVSALHLRSETSTFETPLGAKTLPEDEETPEQEMEETPCRELEEEEEWGSGSEDASKKDGAVESISVPDMVGQKPYVS

SEQ ID NO: 850052 - protein, 112 aa, Homo sapiens
MRGEGHEGGAHMNWIGASVRRGTRRLFSSLSAMGEYSKSWQRPLPEPVSARNPRAWVACRRFQWVDGSRWNFAYWAAHQPWSRGGHCVALCTRGGYWRRAHCLRRLPFICSY

SEQ ID NO: 850053 - protein, 189 aa, Homo sapiens
PKAPHVTVSLHTYHIFFPEAFTNCIGPKHYSQAALEEMHCSGPPKARDRTTGWRMISLQGTHARGSLADAFSGLTAAAGTLRTGLLTSPGPAVVTAWPCVPEEATGVEPTASEDFLSSVPTELVPASSSELPSPGQLPPLLCLPSLPPPPCNKMGFTEMDLFSPLIADPLCLALIETSSLSSLPTPQLS

SEQ ID NO: 850054 - protein, 1325 aa, Homo sapiens
MLPVYQEVKPNPLQDANICSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQTLLQVVGVVSVAVAVIPWIAIPLVPLGIIFIFLRRYFLETSRDVKRLESTTRSPVFSHLSSSLQGLWTIRAYKAEERCQELFDAHQDLHSEAWFLFLTTSRWFAVRLDAICAMFVIIVAFGSLILAKTLDAGQVGLALSYALTLMGMFQWCVRQSAEVENMMISVERVIEYTDLEKEAPWEYQKRPPPAWPHEGVIIFDNVNFMYSPGGPLVLKHLTALIKSQEKVGIVGRTGAGKSSLISALFRLSEPEGKIWIDKILTTEIGLHDLRKKMSIIPQEPVLFTGTMRKNLDPFNEHTDEELWNALQEVQLKETIEDLPGKMDTELAESGSNFSVGQRQLVCLARAILRKNQILIIDEATANVDPRTDELIQKKIREKFAHCTVLTIAHRLNTIIDSDKIMVLDSGRLKEYDEPYVLLQNKESLFYKMVQQLGKAEAAALTETAKQVYFKRNYPHIGHTDHMVTNTSNGQPSTLTIFETAL

SEQ ID NO: 850055 - protein, 1325 aa, Homo sapiens; identical to SEQ ID NO: 850054

SEQ ID NO: 850056 - protein, 1325 aa, Homo sapiens; identical to SEQ ID NO: 850054

SEQ ID NO: 850057 - protein, 470 aa, Homo sapiens
MKPPRRPACAVWWIRDHGAWEAAGFSAPSLTELFSLSVSPARSPVFSHLSSSLQGLWTIRAYKAEERCQELFDAHQDLHSEAWFLFLTTSRWFAVRLDAICAMFVIIVAFGSLILAKTLDAGQVGLALSYALTLMGMFQWCVRQSAEVENMMISVERVIEYTDLEKEAPWEYQKRPPPAWPHEGVIIFDNVNFMYSPGGPLVLKHLTALIKSQEKVGIVGRTGAGKSSLISALFRLSEPEGKIWIDKILTTEIGLHDLRKKMSIIPQEPVLFTGTMRKNLDPFNEHTDEELWNALQEVQLKETIEDLPGKMDTELAESGSNFSVGQRQLVCLARAILRKNQILIIDEATANVDPRTDELIQKKIREKFAHCTVLTIAHRLNTIIDSDKIMVLDSGRLKEYDEPYVLLQNKESLFYKMVQQLGKAEAAALTETAKQVYFKRNYPHIGHTDHMVTNTSNGQPSTLTIFETAL

SEQ ID NO: 850058 - protein, 225 aa, Homo sapiens
DLINPNFTFGFWRFKEENVNHTEPVLFTGTMRKNLDPFNEHTDEELWNALQEVQLKETIEDLPGKMDTELAESGSNFSVGQRQLVCLARAILRKNQILIIDEATANVDPRTDELIQKKIREKFAHCTVLTIAHRLNTIIDSDKIMVLDSGRLKEYDEPYVLLQNKESLFYKMVQQLGKAEAAALTETAKQVYFKRNYPHIGHTDHMVTNTSNGQPSTLTIFETAL

SEQ ID NO: 850059 - protein, 327 aa, Homo sapiens
MGMFQWCVRQSAEVENMMISVERVIEYTDLEKEAPWEYQKRPPPAWPHEGVIIFDNVNFMYSPGGPLVLKHLTALIKSQEKVGIVGRTGAGKSSLISALFRLSEPEGKIWIDKILTTEIGLHDLRKKMSIIPQEPVLFTGTMRKNLDPFNEHTDEELWNALQEVQLKETIEDLPGKMDTELAESGSNFSVGQRQLVCLARAILRKNQILIIDEATANVDPRTDELIQKKIREKFAHCTVLTIAHRLNTIIDSDKIMVLDSGRLKEYDEPYVLLQNKESLFFTRWVANHLGPGEAACPSLGNPNRVLLSQRDFPLFGFTGPLGVNPFP

SEQ ID NO: 850060 - protein, 301 aa, Homo sapiens
MLPVYQEVKPNPLQDANICSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYACGKTGSSESLA

SEQ ID NO: 850061 - protein, 1325 aa, Homo sapiens; identical to SEQ ID NO: 850054

SEQ ID NO: 850062 - protein, 336 aa, Homo sapiens [sequence omitted]

SEQ ID NO: 850063 - protein, 286 aa, Homo sapiens
LHLLGSSDSPVSASRVAGITGAPHPAWLLFVFLVEMGFHHVGQAGLELLTTSEPPASASQSAGITGMSHHTQPGHMFNISLSYEPVLFTGTMRKNLDPFNEHTDEELWNALQEVQLKETIEDLPGKMDTELAESGSNFSVGQRQLVCLARAILRKNQILIIDEATANVDPRTDELIQKKIREKFAHCTVLTIAHRLNTIIDSDKIMVLDSGRLKEYDEPYVLLQNKESLFYKMVQQLGKAEAAALTETAKQVYFKRNYPHIGHTDHMVTNTSNGQPSTLTIFETAL

SEQ ID NO: 850064 - protein, 954 aa, Homo sapiens
MLPVYQEVKPNPLQDANICSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQTLLQVVGVVSVAVAVIPWIAIPLVPLGIIFIFLRRYFLETSRDVKRLESTTRSPVFSHLSSSLQGLWTIRAYKAEERCQELFDAHQDLHSGLSISGNGFKGQDLLLFLA

SEQ ID NO: 850065 - protein, 99 aa, Homo sapiens
AAAYYYKIRGRVDLELHLRMARTLEPLAKKIFKGVLVAELVGVFGAYFLFSKMHTSQDFRQTMSKKYPFILEVYYKSTEKSGMYGIRELDQKTWLNSKN

SEQ ID NO: 850066 - protein, 682 aa, Homo sapiens
SPTMVLSSKEEEQQRLINDLTAQRARLQTESGEYSRQLDEKDTLVSQLSRGKQAFTQQIEELKRQLEEEIKAKSALAHALQSSRHDCDLLREQYEEEQEAKAELQRAMSKANSEVAQWRTKYETDAIQRTEELEEAKKKLAQRLQDAEEHVEAVNAKCASLEKTKQRLQNEVEDLMIDVERTNAACAALDKKQRNFDKILAEWKQKCEETHAELEASQKESRSLSTELFKIKNAYEESLDQLETLKRENKNLQQEISDLTEQIAEGGKRIHELEKIKKQVEQEKSELQAALEEAEASLEHEEGKILRIQLELNQVKSEVDRKIAEKDEEIDQMKRNHIRIVESMQSTLDAEIRSRNDAIRLKKKMEGDLNEMEIQLNHANRMAAEALRNYRNTQAILKDTQLHLDDALRSQEDLKEQLAMVERRANLLQAEIEELRATLEQTERSRKIAEQELLDASERVQLLHTQNTSLINTKKKLETDISQIQGEMEDIIQEARNAEEKAKKAITDAAMMAEELKKEQDTSAHLERMKKNLEQTVKDLQHRLDEAEQLALKGGKKQIQKLEARVRELEGEVESEQKRNVEAVKGLRKHERKVKELTYQTEEDRKNILRLQDLVDKLQAKVKSYKRQAEEAEEQSNVNLSKFRRIQHELEEAEERADIAESQVNKLRVKSREVHTKIISEE

SEQ ID NO: 850067 - protein, 1901 aa, Homo sapiens
MSSDSEMAIFGEAAPFLRKSERERIEAQNKPFDAKTSVFVVDPKESFVKATVQSREGGKVTAKTEAGATVTVKDDQVFPMNPPKYDKIEDMAMMTHLHEPAVLYNLKERYAAWMIYTYSGLFCVTVNPYKWLPVYNAEVVTAYRGKKRQEAPPHIFSISDNAYQFMLTDRENQSILITGESGAGKTVNTKRVIQYFATIAVTGEKKKEEVTSGKMQGTLEDQIISANPLLEAFGNAKTVRNDNSSRFGKFIRIHFGTTGKLASADIETYLLEKSRVTFQLKAERSYHIFYQIMSNKKPDLIEMLLITTNPYDYAFVSQGEITVPSIDDQEELMATDSAIEILGFTSDERVSIYKLTGAVMHYGNMKFKQKQREEQAEPDGTEVADKAAYLQNLNSADLLKALCYPRVKVGNEYVTKGQTVQQVYNAVGALAKAVYDKMFLWMVTRINQQLDTKQPRQYFIGVLDIAGFEIFDFNSLEQLCINFTNEKLQQFFNHHMFVLEQEEYKKEGIEWTFIDFGMDLAACIELIEKPMGIFSILEEECMFPKATDTSFKNKLYEQHLGKSNNFQKPKPAKGKPEAHFSLIHYAGTVDYNIAGWLDKNKDPLNETVVGLYQKSAMKTLALLFVGATGAEAEAGGGKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLGSIDIDHTQYKFGHTKVFFKAGLLGLLEEMRDEKLAQLITRTQAMCRGFLARVEYQKMVERRESIFCIQYNVRAFMNVKHWPWMKLYFKIKPLLKSAETEKEMATMKEEFEKTKEELAKTEAKRKELEEKMVTLMQEKNDLQLQVQAEADSLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKIKLEQQVDDLEGSLEQEKKIRMDLERAKRKLEGDLKLAQESAMDIENDKQQLDEKLKKKEFEMSGLQSKIEDEQALGMQLQKKIKELQARIEELEEEIEAERASRAKAEKQRSDLSRELEEISERLEEAGGATSAQIEMNKKREAEFQKMRRDLEEATLQHEATAATLRKKHADSVAELGEQIDNLQRVKQKLEKEKSEMKMEIDDLASNMETVSKAKGNLEKMCRALEDQLSEIKTKEEEQQRLINDLTAQRARLQTESGEYSRQLDEKDTLVSQLSRGKQAFTQQIEELKRQLEEEIKAKSALAHALQSSRHDCDLLREQYEEEQEAKAELQRAMSKANSEVAQWRTKYETDAIQRTEELEEAKKKLAQRLQDAEEHVEAVNAKCASLEKTKQRLQNEVEDLMIDVERTNAACAALDKKQRNFDKILAEWKQKCEETHAELEASQKESRSLSTELFKIKNAYEESLDQLETLKRENKNLQQEISDLTEQIAEGGKRIHELEKIKKQVEQEKSELQAALEEAEASLEHEEGKILRIQLELNQVKSEVDRKIAEKDEEIDQMKRNHIRIVESMQSTLDAEIRSRNDAIRLKKKMEGDLNEMEIQLNHANRMAAEALRNYRNTQAILKDTQLHLDDALRSQEDLKEQLAMVERRANLLQAEIEELRATLEQTERSRKIAEQELLDASERVQLLHTQNTSLINTKKKLETDISQIQGEMEDIIQEARNAEEKAKKAITDAAMMAEELKKEQDTSAHLERMKKNLEQTVKDLQHRLDEAEQLALKGGKKQIQKLEARVRELEGEVESEQKRNVEAVKGLRKHERKVKELTYQTEEDRKNILRLQDLVDKLQAKVKSYKRQAEEADPARAGGGRGTG

SEQ ID NO: 850068 - protein, 144 aa, Homo sapiens
SLSITLLLTLNLSFQLPYPGLQKLEARVRELEGEVESEQKRNVEAVKGLRKHERKVKELTYQTEEDRKNILRLQDLVDKLQAKVKSYKRQAEEAEEQSNVNLSKFRRIQHELEEAEERADIAESQVNKLRVKSREVHTKIISEE

SEQ ID NO: 850069 - protein, 1939 aa, Homo sapiens
MSSDSEMAIFGEAAPFLRKSERERIEAQNKPFDAKTSVFVVDPKESFVKATVQSREGGKVTAKTEAGATVTVKDDQVFPMNPPKYDKIEDMAMMTHLHEPAVLYNLKERYAAWMIYTYSGLFCVTVNPYKWLPVYNAEVVTAYRGKKRQEAPPHIFSISDNAYQFMLTDRENQSILITGESGAGKTVNTKRVIQYFATIAVTGEKKKEEVTSGKMQGTLEDQIISANPLLEAFGNAKTVRNDNSSRFGKFIRIHFGTTGKLASADIETYLLEKSRVTFQLKAERSYHIFYQIMSNKKPDLIEMLLITTNPYDYAFVSQGEITVPSIDDQEELMATDSAIEILGFTSDERVSIYKLTGAVMHYGNMKFKQKQREEQAEPDGTEVADKAAYLQNLNSADLLKALCYPRVKVGNEYVTKGQTVQQVYNAVGALAKAVYDKMFLWMVTRINQQLDTKQPRQYFIGVLDIAGFEIFDFNSLEQLCINFTNEKLQQFFNHHMFVLEQEEYKKEGIEWTFIDFGMDLAACIELIEKPMGIFSILEEECMFPKATDTSFKNKLYEQHLGKSNNFQKPKPAKGKPEAHFSLIHYAGTVDYNIAGWLDKNKDPLNETVVGLYQKSAMKTLALLFVGATGAEAEAGGGKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLGSIDIDHTQYKFGHTKVFFKAGLLGLLEEMRDEKLAQLITRTQAMCRGFLARVEYQKMVERRESIFCIQYNVRAFMNVKHWPWMKLYFKIKPLLKSAETEKEMATMKEEFEKTKEELAKTEAKRKELEEKMVTLMQEKNDLQLQVQAEADSLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKIKLEQQVDDLEGSLEQEKKIRMDLERAKRKLEGDLKLAQESAMDIENDKQQLDEKLKKKEFEMSGLQSKIEDEQALGMQLQKKIKELQARIEELEEEIEAERASRAKAEKQRSDLSRELEEISERLEEAGGATSAQIEMNKKREAEFQKMRRDLEEATLQHEATAATLRKKHADSVAELGEQIDNLQRVKQKLEKEKSEMKMEIDDLASNMETVSKAKGNLEKMCRALEDQLSEIKTKEEEQQRLINDLTAQRARLQTESGEYSRQLDEKDTLVSQLSRGKQAFTQQIEELKRQLEEEIKAKSALAHALQSSRHDCDLLREQYEEEQEAKAELQRAMSKANSEVAQWRTKYETDAIQRTEELEEAKKKLAQRLQDAEEHVEAVNAKCASLEKTKQRLQNEVEDLMIDVERTNAACAALDKKQRNFDKILAEWKQKCEETHAELEASQKESRSLSTELFKIKNAYEESLDQLETLKRENKNLQQEISDLTEQIAEGGKRIHELEKIKKQVEQEKSELQAALEEAEASLEHEEGKILRIQLELNQVKSEVDRKIAEKDEEIDQMKRNHIRIVESMQSTLDAEIRSRNDAIRLKKKMEGDLNEMEIQLNHANRMAAEALRNYRNTQAILKDTQLHLDDALRSQEDLKEQLAMVERRANLLQAEIEELRATLEQTERSRKIAEQELLDASERVQLLHTQNTSLINTKKKLETDISQIQGEMEDIIQEARNAEEKAKKAITDAAMMAEELKKEQDTSAHLERMKKNLEQTVKDLQHRLDEAEQLALKGGKKQIQKLEARVRELEGEVESEQKRNVEAVKGLRKHERKVKELTYQTEEDRKNILRLQDLVDKLQAKVKSYKRQAEEAEEQSNVNLSKFRRIQHELEEAEERADIAESQVNKLRVKSREVHTKIISEE

SEQ ID NO: 850070 - protein, 1939 aa, Homo sapiens; identical to SEQ ID NO: 850069

SEQ ID NO: 850071 - protein, 161 aa, Homo sapiens
EKKEDCGRGENLEQTVKDLQHRLDEAEQLALKGGKKQIQKLEARVRELEGEVESEQKRNVEAVKGLRKHERKVKELTYQTEEDRKNILRLQDLVDKLQAKVKSYKRQAEEAEEQSNVNLSKFRRIQHELEEAEERADIAESQVNKLRVKSREVHTKIISEE

SEQ ID NO: 850072 - protein, 484 aa, Homo sapiens
GGEAAVEGAGGGDAALGEPGLSFTTTDLSLVEMTEVEYTQLQHILCSHMEAAADGELETRLNSALLAAAGPGAGAGGFAAGGQGGAAPVYPVLCPSALAADAPCLGHIDFQELRMMLLSEAGAAEKTSGGGDGARARADGAAKEGAGAAAAAAGPDGAPEARAKPAVRVRLEDRFNSIPAEPPPAPRGPEPPEPGGALNNLVTLIRHPSELMNVPLQQQNKCTALVKNKTAATTTALQFTYPLFTTNACSTSGNSNLSQTQSSSNSCSVLEAAKHQDIGLPRAFSFCYQQEIESTKQTLGSRNKVLPEQVWIKVGEAALCKQALKRNRSRMRQLDTNVERRALGEIQNVGEGATATQGAWQSSESSQANLGEQAQSGPQGGRSQRRERHNRMERDRRRRIRICCDELNLLVPFCNAETDKATTLQWTTAFLKYIQERHGDSLKKEFESVFCGKTGRRLKLTRPDSLVTCPAQGSLQSSPSMEIK

SEQ ID NO: 850073 - protein, 228 aa, Homo sapiens
GGEAAVEGAGGGDAALGEPGLSFTTTDLSLVEMTEVEYTQLQHILCSHMEAAADGELETRLNSALLAAAGPGAGAGGFAAGGQGGAAPVYPVLCPSALAADAPCLGHIDFQELRMMLLSEAGAAEKTSGGGDGARARADGAAKEGAGAAAAAAGPDGAPEARAKPAVRVRLEDRFNSIPAEPPPAPRGPEPPEPGGALNKCVPGGRGLAGPGWRPRPGPGPGRRQRGP

SEQ ID NO: 850074 - protein, 273 aa, Homo sapiens
MNVPLQQQNKCTALVKNKTAATTTALQFTYPLFTTNACSTSGNSNLSQTQSSSNSCSVLEAAKHQDIGLPRAFSFCYQQEIESTKQTLGSRNKVLPEQVWIKVGEAALCKQALKRNRSRMRQLDTNVERRALGEIQNVGEGATATQGAWQSSESSQANLGEQAQSGPQGGRSQRRERHNRMERDRRRRIRICCDELNLLVPFCNAETDKATTLQWTTAFLKYIQERHGDSLKKEFESVFCGKTGRRLKLTRPDSLVTCPAQGSLQSSPSMEIK

SEQ ID NO: 850075 - protein, 273 aa, Homo sapiens; identical to SEQ ID NO: 850074

SEQ ID NO: 850076 - protein, 273 aa, Homo sapiens; identical to SEQ ID NO: 850074

SEQ ID NO: 850077 - protein, 105 aa, Homo sapiens
MFVLLRSLSVMTLGFDYRRRIRICCDELNLLVPFCNAETDKATTLQWTTAFLKYIQERHGDSLKKEFESVFCGKTGRRLKLTRPDSLVTCPAQGSLQSSPSMEIK

SEQ ID NO: 850078 - protein, 235 aa, Homo sapiens
MDSDEMKKILAENSRKITVLQVNEKSLIRQYTTLVELERQLRKENEKQKNELLSMEAEVCEKIGCLQRFKEMAIFKIAALQKVVDNSVSLSELELANKQYNELTAKYRDILQKDNMLVQRTSNLEHLECENISLKEQVESINKELEITKEKLHTIEQAWEQETKLGNESSMDKAKKSITNSDIVSISKKITMLEMKELNERQRAEHCQKMYEHLRTSLKQMEERNFELETKFAEV

SEQ ID NO: 850079 - protein, 1610 aa, Homo sapiens
MDSDEMKKILAENSRKITVLQVNEKSLIRQYTTLVELERQLRKENEKQKNELLSMEAEVCEKIGCLQRFKEMAIFKIAALQKVVDNSVSLSELELANKQYNELTAKYRDILQKDNMLVQRTSNLEHLECENISLKEQVESINKELEITKEKLHTIEQAWEQETKLGNESSMDKAKKSITNSDIVSISKKITMLEMKELNERQRAEHCQKMYEHLRTSLKQMEERNFELETKFAELTKINLDAQKVEQMLRDELADSVSKAVSDADRQRILELEKNEMELKVEVSKLREISDIARRQVEILNAQQQSRDKEVESLRMQLLDYQAQSDEKSLIAKLHQHNVSLQLSEATALGKLESITSKLQKMEAYNLRLEQKLDEKEQALYYARLEGRNRAKHLRQTIQSLRRQFSGALPLAQQEKFSKTMIQLQNDKLKIMQEMKNSQQEHRNMENKTLEMELKLKGLEELISTLKDTKGAQKVINWHMKIEELRLQELKLNRELVKDKEEIKYLNNIISEYERTISSLEEEIVQQNKFHEERQMAWDQREVDLERQLDIFDRQQNEILNAAQKFEEATGSIPDPSLPLPNQLEIALRKIKENIRIILETRATCKSLEEKLKEKESALRLAEQNILSRDKVINELRLRLPATAEREKLIAELGRKEMEPKSHHTLKIAHQTIANMQARLNQKEEVLKKYQRLLEKAREEQREIVKKHEEDLHILHHRLELQADSSLNKFKQTAWDLMKQSPTPVPTNKHFIRLAEMEQTVAEQDDSLSSLLVKLKKVSQDLERQREITELKVKEFENIKLQLQENHEDEVKKVKAEVEDLKYLLDQSQKESQCLKSELQAQKEANSRAPTTTMRNLVERLKSQLALKEKQQKALSRALLELRAEMTAAAEERIISATSQKEAHLNVQQIVDRHTRELKTQVEDLNENLLKLKEALKTSKNRENSLTDNLNDLNNELQKKQKAYNKILREKEEIDQENDELKRQIKRLTSGLQGKPLTDNKQSLIEELQRKVKKLENQLEGKVEEVDLKPMKEKNAKEELIRWEEGKKWQAKIEGIRNKLKEKEGEVFTLTKQLNTLKDLFAKADKEKLTLQRKLKTTGMTVDQVLGIRALESEKELEELKKRNLDLENDILYMRAHQALPRDSVVEDLHLQNRYLQEKLHALEKQFSKDTYSKPSISGIESDDHCQREQELQKENLKLSSENIELKFQLEQANKDLPRLKNQVRDLKEMCEFLKKEKAEVQRKLGHVRGSGRSGKTIPELEKTIGLMKKVVEKVQRENEQLKKASGILTSEKMANIEQENEKLKAELEKLKAHLGHQLSMHYESKTKGTEKIIAENERLRKELKKETDAAEKLRIAKNNLEILNEKMTVQLEETGKRLQFAESRGPQLEGADSKSWKSIVVTRMYETKLKELETDIAKKNQSITDLKQLVKEATEREQKVNKYNEDLEQQIKILKHVPEGAETEQGLKRELQVLRLANHQLDKEKAELIHQIEANKDQSGAESTIPDADQLKEKIKDLETQLKMSDLEKQHLKEEIKKLKKELENFDPSFFEEIEDLKYNYKEEVKKNILLEEKVKKLSEQLGVELTSPVAASEEFEDEEESPVNFPIY

SEQ ID NO: 850080 - protein, 290 aa, Homo sapiens
MHYESKTKGTEKIIAENERLRKELKKETDAAEKLRIAKNNLEILNEKMTVQLEETGKRLQFAESRGPQLEGADSKSWKSIVVTRMYETKLKELETDIAKKNQSITDLKQLVKEATEREQKVNKYNEDLEQQIKILKHVPEGAETEQGLKRELQVLRLANHQLDKEKAELIHQIEANKDQSGAESTIPDADQLKEKIKDLETQLKMSDLEKQHLKEEIKKLKKELENFDPSFFEEIEDLKYNYKEEVKKNILLEEKVKKLSEQLGVELTSPVAASEEFEDEEESPVNFPIY

SEQ ID NO: 850081 - protein, 1539 aa, Homo sapiens
MAIFKIAALQKVVDNSVSLSELELANKQYNELTAKYRDILQKDNMLVQRTSNLEHLECENISLKEQVESINKELEITKEKLHTIEQAWEQETKLGNESSMDKAKKSITNSDIVSISKKITMLEMKELNERQRAEHCQKMYEHLRTSLKQMEERNFELETKFAELTKINLDAQKVEQMLRDELADSVSKAVSDADRQRILELEKNEMELKVEVSKLREISDIARRQVEILNAQQQSRDKEVESLRMQLLDYQAQSDEKSLIAKLHQHNVSLQLSEATALGKLESITSKLQKMEAYNLRLEQKLDEKEQALYYARLEGRNRAKHLRQTIQSLRRQFSGALPLAQQEKFSKTMIQLQNDKLKIMQEMKNSQQEHRNMENKTLEMELKLKGLEELISTLKDTKGAQKVINWHMKIEELRLQELKLNRELVKDKEEIKYLNNIISEYERTISSLEEEIVQQNKFHEERQMAWDQREVDLERQLDIFDRQQNEILNAAQKFEEATGSIPDPSLPLPNQLEIALRKIKENIRIILETRATCKSLEEKLKEKESALRLAEQNILSRDKVINELRLRLPATAEREKLIAELGRKEMEPKSHHTLKIAHQTIANMQARLNQKEEVLKKYQRLLEKAREEQREIVKKHEEDLHILHHRLELQADSSLNKFKQTAWDLMKQSPTPVPTNKHFIRLAEMEQTVAEQDDSLSSLLVKLKKVSQDLERQREITELKVKEFENIKLQLQENHEDEVKKVKAEVEDLKYLLDQSQKESQCLKSELQAQKEANSRAPTTTMRNLVERLKSQLALKEKQQKALSRALLELRAEMTAAAEERIISATSQKEAHLNVQQIVDRHTRELKTQVEDLNENLLKLKEALKTSKNRENSLTDNLNDLNNELQKKQKAYNKILREKEEIDQENDELKRQIKRLTSGLQGKPLTDNKQSLIEELQRKVKKLENQLEGKVEEVDLKPMKEKNAKEELIRWEEGKKWQAKIEGIRNKLKEKEGEVFTLTKQLNTLKDLFAKADKEKLTLQRKLKTTGMTVDQVLGIRALESEKELEELKKRNLDLENDILYMRAHQALPRDSVVEDLHLQNRYLQEKLHALEKQFSKDTYSKPSISGIESDDHCQREQELQKENLKLSSENIELKFQLEQANKDLPRLKNQVRDLKEMCEFLKKEKAEVQRKLGHVRGSGRSGKTIPELEKTIGLMKKVVEKVQRENEQLKKASGILTSEKMANIEQENEKLKAELEKLKAHLGHQLSMHYESKTKGTEKIIAENERLRKELKKETDAAEKLRIAKNNLEILNEKMTVQLEETGKRLQFAESRGPQLEGADSKSWKSIVVTRMYETKLKELETDIAKKNQSITDLKQLVKEATEREQKVNKYNEDLEQQIKILKHVPEGAETEQGLKRELQVLRLANHQLDKEKAELIHQIEANKDQSGAESTIPDADQLKEKIKDLETQLKMSDLEKQHLKEEIKKLKKELENFDPSFFEEIEDLKYNYKEEVKKNILLEEKVKKLSEQLGVELTSPVAASEEFEDEEESPVNFPIY

SEQ ID NO: 850082 - protein, 1571 aa, Homo sapiens
MDSDEMKKILAENSRKITVLQVNEKSLIRQYTTLVELERQLRKENEKQKNELLSMEAEVCEKIGCLQRFKEMAIFKIAALQKVVDNSVSLSELELANKQYNELTAKYRDILQKDNMLVQRTSNLEHLECENISLKEQVESINKELEITKEKLHTIEQAWEQETKLGNESSMDKAKKSITNSDIVSISKKITMLEMKELNERQRAEHCQKMYEHLRTSLKQMEERNFELETKFAELTKINLDAQKVEQMLRDELADSVSKAVSDADRQRILELEKNEMELKVEVSKLREISDIARRQVEILNAQQQSRDKEVESLRMQLLDYQAQSDEKSLIAKLHQHNVLSIMLVWREETEQNICAKQFSLYDDSLVELYPWHNRKSSPKQMIQLQNDKLKIMQEMKNSQQEHRNMENKTLEMELKLKGLEELISTLKDTKGAQKVINWHMKIEELRLQELKLNRELVKDKEEIKYLNNIISEYERTISSLEEEIVQQNKFHEERQMAWDQREVDLERQLDIFDRQQNEILNAAQKFEEATGSIPDPSLPLPNQLEIALRKIKENIRIILETRATCKSLEEKLKEKESALRLAEQNILSRDKVINELRLRLPATAEREKLIAELGRKEMEPKSHHTLKIAHQTIANMQARLNQKEEVLKKYQRLLEKAREEQREIVKKHEEDLHILHHRLELQADSSLNKFKQTAWDLMKQSPTPVPTNKHFIRLAEMEQTVAEQDDSLSSLLVKLKKVSQDLERQREITELKVKEFENIKLQLQENHEDEVKKVKAEVEDLKYLLDQSQKESQCLKSELQAQKEANSRAPTTTMRNLVERLKSQLALKEKQQKALSRALLELRAEMTAAAEERIISATSQKEAHLNVQQIVDRHTRELKTQVEDLNENLLKLKEALKTSKNRENSLTDNLNDLNNELQKKQKAYNKILREKEEIDQENDELKRQIKRLTSGLQGKPLTDNKQSLIEELQRKVKKLENQLEGKVEEVDLKPMKEKNAKEELIRWEEGKKWQAKIEGIRNKLKEKEGEVFTLTKQLNTLKDLFAKADKEKLTLQRKLKTTGMTVDQVLGIRALESEKELEELKKRNLDLENDILYMRAHQALPRDSVVEDLHLQNRYLQEKLHALEKQFSKDTYSKPSISGIESDDHCQREQELQKENLKLSSENIELKFQLEQANKDLPRLKNQVRDLKEMCEFLKKEKAEVQRKLGHVRGSGRSGKTIPELEKTIGLMKKVVEKVQRENEQLKKASGILTSEKMANIEQENEKLKAELEKLKAHLGHQLSMHYESKTKGTEKIIAENERLRKELKKETDAAEKLRIAKNNLEILNEKMTVQLEETGKRLQFAESRGPQLEGADSKSWKSIVVTRMYETKLKELETDIAKKNQSITDLKQLVKEATEREQKVNKYNEDLEQQIKILKHVPEGAETEQGLKRELQVLRLANHQLDKEKAELIHQIEANKDQSGAESTIPDADQLKEKIKDLETQLKMSDLEKQHLKEEIKKLKKELENFDPSFFEEIEDLKYNYKEEVKKNILLEEKVKKLSEQLGVELTSPVAASEEFEDEEESPVNFPIY

SEQ ID NO: 850083 - protein, 1555 aa, Homo sapiens
MDSDEMKKILAENSRKITVLQVNEKSLIRQYTTLVELERQLRKENEKQKNELLSMEAEVCEKIGCLQRFKEMAIFKIAALQKVVDNSVSLSELELANKQYNELTAKYRDILQKDNMLVQRTSNLEHLECENISLKEQVESINKELEITKEKLHTIEQAWEQETKLGNESSMDKAKKSITNSDIVSISKKITMLEMKELNERQRAEHCQKMYEHLRTSLKQMEERNFELETKFAELTKINLDAQKVEQMLRDELADSVSKAVSDADRQRILELEKNEMELKVEVSKLREISDIARRQVEILNAQQQSRDKEVESLRMQLLDYQAQSDEKSLIAKLHQHNVSLQLSEATALGKLESITSKLQKMEAYNLRLEQKLDEKEQALYYARLEGRNRAKHLRQTIQSLRRQFSGALPLAQQEKFSKTMIQLQNDKLKIMQEMKNSQQEHRNMENKTLEMELKLKGLEELISTLKDTKGAQKVINWHMKIEELRLQELKLNRELVKDKEEIKYLNNIISEYERTISSLEEEIVQQNKFHEERQMAWDQREVDLERQLDIFDRQQNEILNAAQKFEEATGSIPDPSLPLPNQLEIALRKIKENIRIILETRATCKSLEEKLKEKESALRLAEQNILSRDKVINELRLRLPATAEREKLIAELGRKEMEPKSHHTLKIAHQTIANMQARLNQKEEVLKKYQRLLEKAREEQREIVKKHEEDLHILHHRLELQADSSLNKFKQTAWDLMKQSPTPVPTNKHFIRLAEMEQTVAEQDDSLSSLLVKLKKVSQDLERQREITELKVKEFENIKLQLQENHEDEVKKVKAEVEDLKYLLDQSQKESQCLKSELQAQKEANSRAPTTTMRNLVERLKSQLALKEKQQKALSRALLELRAEMTAAAEERIISATSQKEAHLNVQQIVDRHTRELKTQVEDLNENLLKLKEALKTSKNRENSLTDNLNDLNNELQKKQKAYNKILREKEEIDQENDELKRQIKRLTSGLQGKPLTDNKQSLIEELQRKVKKLENQLEGKVEEVDLKPMKEKNAKEELIRWEEGKKWQAKIEGIRNKLKEKEGEVFTLTKQLNTLKDLFAKADKEKLTLQRKLKTTGMTVDQVLGIRALESEKELEELKKRNLDLENDILYMRAHQALPRDSVVEDLHLQNRYLQEKLHALEKQFSKDTYSKPSISGIESDDHCQREQELQKENLKLSSENIELKFQLEQANKDLPRLKNQVRDLKEMCEFLKKEKAEVQRKLGHVRGAELEKLKAHLGHQLSMHYESKTKGTEKIIAENERLRKELKKETDAAEKLRIAKNNLEILNEKMTVQLEETGKRLQFAESRGPQLEGADSKSWKSIVVTRMYETKLKELETDIAKKNQSITDLKQLVKEATEREQKVNKYNEDLEQQIKILKHVPEGAETEQGLKRELQVLRLANHQLDKEKAELIHQIEANKDQSGAESTIPDADQLKEKIKDLETQLKMSDLEKQHLKEEIKKLKKELENFDPSFFEEIEDLKYNYKEEVKKNILLEEKVKKLSEQLGVELTSPVAASEEFEDEEESPVNFPIY

SEQ ID NO: 850084 - protein, 429 aa, Homo sapiens
MSGGVYGGDEVGALVFDIGSYTVRAGYAGEDCPKVDFPTAIGMVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAFANGRSTGLILDSGATHTTAIPVHDGYVLQQGIVKSPLAGDFITMQCRELFQEMNIELVPPYMIASKEAVREGSPANWKRKEKLPQVTRSWHNYMCNCVIQDFQASVLQVSDSTYDEQVAAQMPTVHYEFPNGYNCDFGAERLKIPEGLFDPSNVKGLSGNTMLGVSHVVTTSVGMCDIDIRPGLYGSVIVAGGNTLIQSFTDRLNRELSQKTPPSMRLKLIANNTTVERRFSSWIGGSILASLGTFQQMWISKQEYEEGGKQCVERKCP

SEQ ID NO: 850085 - protein, 130 aa, Homo sapiens
LLIHFNTPISTDPPLQGLSGNTMLGVSHVVTTSVGMCDIDIRPGLYGSVIVAGGNTLIQSFTDRLNRELSQKTPPSMRLKLIANNTTVERRFSSWIGGSILASLGTFQQMWISKQEYEEGGKQCVERKCP

SEQ ID NO: 850086 - protein, 313 aa, Homo sapiens
TRGSTHASTVRAGYAGEDCPKVDFPTAIGMVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAFANGRSTGLILDSGATHTTAIPVHDGYVLQQGIVKSPLAGDFITMQCRELFQEMNIELVPPYMIASKGKALVTAGKGNSLQRQNVEKDKARSVTIQRYTEGIPLWGTETHEIYNFNLVGFQNYRLRLINTPRGKFYITHKKPLSRRIKSLYTKKGIGFTPRENFFTQ

SEQ ID NO: 850087 - protein, 485 aa, Homo sapiens
RKVCKKRGGTVRNSREGGWRWKLRESGAIAPRDSQSRPLQSLRQLALRVGVAPAAAMSGGVYGGDEVGALVFDIGSYTVRAGYAGEDCPKVDFPTAIGMVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAFANGRSTGLILDSGATHTTAIPVHDGYVLQQGIVKSPLAGDFITMQCRELFQEMNIELVPPYMIASKEAVREGSPANWKRKEKLPQVTRSWHNYMCNCVIQDFQASVLQVSDSTYDEQVAAQMPTVHYEFPNGYNCDFGAERLKIPEGLFDPSNVKGLSGNTMLGVSHVVTTSVGMCDIDIRPGLYGSVIVAGGNTLIQSFTDRLNRELSQKTPPSMRLKLIANNTTVERRFSSWIGGSILASLGTFQQMWISKQEYEEGGKQCVERKCP

SEQ ID NO: 850088 - protein, 429 aa, Homo sapiens; identical to SEQ ID NO: 850084

SEQ ID NO: 850089 - protein, 429 aa, Homo sapiens; identical to SEQ ID NO: 850084

SEQ ID NO: 850090 - protein, 429 aa, Homo sapiens; identical to SEQ ID NO: 850084

SEQ ID NO: 850091 - protein, 429 aa, Homo sapiens; identical to SEQ ID NO: 850084

SEQ ID NO: 850092 - protein, 412 aa, Homo sapiens
FCRVGGLTMVPRLILNSVDFPTAIGMVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAFANGRSTGLILDSGATHTTAIPVHDGYVLQQGIVKSPLAGDFITMQCRELFQEMNIELVPPYMIASKEAVREGSPANWKRKEKLPQVTRSWHNYMCNCVIQDFQASVLQVSDSTYDEQVAAQMPTVHYEFPNGYNCDFGAERLKIPEGLFDPSNVKGLSGNTMLGVSHVVTTSVGMCDIDIRPGLYGSVIVAGGNTLIQSFTDRLNRELSQKTPPSMRLKLIANNTTVERRFSSWIGGSILASLGTFQQMWISKQEYEEGGKQCVERKCP

SEQ ID NO: 850093 - protein, 161 aa, Homo sapiens
MSGGVYGGDEVGALVFDIGSYTVRAGYAGEDCPKVDFPTAIGMVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAYP

SEQ ID NO: 850094 - protein, 174 aa, Homo sapiens
MSGGVYGGDEVGALVFDIGSYTVRAGYAGEDCPKVDFPTAIGMVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCTVEPLIPLQFQSTMAMSFNKAL

SEQ ID NO: 850095 - protein, 161 aa, Homo sapiens; identical to SEQ ID NO: 850093

SEQ ID NO: 850096 - protein, 226 aa, Homo sapiens
MQCRELFQEMNIELVPPYMIASKEAVREGSPANWKRKEKLPQVTRSWHNYMCNCVIQDFQASVLQVSDSTYDEQVAAQMPTVHYEFPNGYNCDFGAERLKIPEGLFDPSNVKGLSGNTMLGVSHVVTTSVGMCDIDIRPGLYGSVIVAGGNTLIQSFTDRLNRELSQKTPPSMRLKLIANNTTVERRFSSWIGGSILASLGTFQQMWISKQEYEEGGKQCVERKCP

SEQ ID NO: 850097 - protein, 429 aa, Homo sapiens; identical to SEQ ID NO: 850084

SEQ ID NO: 850098 - protein, 226 aa, Homo sapiens; identical to SEQ ID NO: 850096

SEQ ID NO: 850099 - protein, 326 aa, Homo sapiens
MSGGVYGGDEVGALVFDIGSYTVRAGYAGEDCPKVDFPTAIGMVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAFANGRSTGLILDSGATHTTAIPVHDGYVLQQGIVKSPLAGDFITMQCRELFQEMNIELVPPYMIASKGKALVTAGKGNSLQRQNVEKDKARSVTIQRYTEGIPLWGTETHEIYNFNLVGFQNYRLRLINTPRGKFYITHKKPLSRRIKSLYTKKGIGFTPRENFFTQ

SEQ ID NO: 850100 - protein, 75 aa, Homo sapiens
RPSGQGRYVLVVRTNAGGVTMMRLKLIANNTTVERRFSSWIGGSILASLGTFQQMWISKQEYEEGGKQCVERKCP

SEQ ID NO: 850101 - protein, 113 aa, Homo sapiens
MSGGVYGGDEVGALVFDIGSYTVRAGYAGEDCPKVDFPTAIGMVVERDDGSTLMEIDGDKGKQGGPTYYIDTNALRVPRENMEAISPLKNGMGDDVFPMELIMECTCYILDTK

SEQ ID NO: 850102 - protein, 387 aa, Homo sapiens
MVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAFANGRSTGLILDSGATHTTAIPVHDGYVLQQGIVKSPLAGDFITMQCRELFQEMNIELVPPYMIASKEAVREGSPANWKRKEKLPQVTRSWHNYMCNCVIQDFQASVLQVSDSTYDEQVAAQMPTVHYEFPNGYNCDFGAERLKIPEGLFDPSNVKGLSGNTMLGVSHVVTTSVGMCDIDIRPGLYGSVIVAGGNTLIQSFTDRLNRELSQKTPPSMRLKLIANNTTVERRFSSWIGGSILASLGTFQQMWISKQEYEEGGKQCVERKCP

SEQ ID NO: 850103 - protein, 244 aa, Homo sapiens
DAWVDPRVDSGATHTTAIPVHDGYVLQQGIVKSPLAGDFITMQCRELFQEMNIELVPPYMIASKEAVREGSPANWKRKEKLPQVTRSWHNYMCNCVIQDFQASVLQVSDSTYDEQVAAQMPTVHYEFPNGYNCDFGAERLKIPEGLFDPSNVKGLSGNTMLGVSHVVTTSVGMCDIDIRPGLYGSVIVAGGNTLIQSFTDRLNRELSQKTPPSMRLKLIANNTTVERRFSSWIGGSILASLVSR

SEQ ID NO: 850104 - protein, 387 aa, Homo sapiens; identical to SEQ ID NO: 850102

SEQ ID NO: 850105 - protein, 387 aa, Homo sapiens; identical to SEQ ID NO: 850102

SEQ ID NO: 850106 - protein, 429 aa, Homo sapiens; identical to SEQ ID NO: 850084

SEQ ID NO: 850107 - protein, 355 aa, Homo sapiens
MSGGVYGGDEVGALVFDIGSYTVRAGYAGEDCPKVDFPTAIGMVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAFANGRSTGLILDSGATHTTAIPVHDGYVLQQGIVKSPLAGDFITMQCRELFQEMNIELVPPYMIASKEAVREGSPANWKRKEKLPQVTRSWHNYMCNCVIQDFQASVLQVSDSTYDEQVAAQMPTVHYEFPNGYNCDFGAERLKIPEGLFDPSNVKGLSGNTMLGVSHVVTTSVGMWISKQEYEEGGKQCVERKCP

SEQ ID NO: 850108 - protein, 166 aa, Homo sapiens
MSGGVYGGDEVGALVFDIGSYTVRAGYAGEDCPKVDFPTAIGMVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAFIHHLLH

SEQ ID NO: 850109 - protein, 321 aa, Homo sapiens
MGWLKTGIVSKLFWIIPTWNTRAKREKLTELMFEHYNIPAFFLCKTAVLTAFANGRSTGLILDSGATHTTAIPVHDGYVLQQGIVKSPLAGDFITMQCRELFQEMNIELVPPYMIASKEAVREGSPANWKRKEKLPQVTRSWHNYMCNCVIQDFQASVLQVSDSTYDEQVAAQMPTVHYEFPNGYNCDFGAERLKIPEGLFDPSNVKGLSGNTMLGVSHVVTTSVGMCDIDIRPGLYGSVIVAGGNTLIQSFTDRLNRELSQKTPPSMRLKLIANNTTVERRFSSWIGGSILASLGTFQQMWISKQEYEEGGKQCVERKCP

SEQ ID NO: 850110 - protein, 429 aa, Homo sapiens; identical to SEQ ID NO: 850084

SEQ ID NO: 850111 - protein, 355 aa, Homo sapiens; identical to SEQ ID NO: 850107

SEQ ID NO: 850112 - protein, 429 aa, Homo sapiens; identical to SEQ ID NO: 850084

SEQ ID NO: 850113 - protein, 406 aa, Homo sapiens [sequence omitted]

SEQ ID NO: 850114 - protein, 215 aa, Homo sapiens
MSGGVYGGDEVGALVFDIGSYTVRAGYAGEDCPKVDFPTAIGMVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAFANGRSTGLILDSGATHTTAFPSPQNPENFGGGPLFKILGVFPPPFFFPKKTPKKR

SEQ ID NO: 850115 - protein, 180 aa, Homo sapiens
RAVQLVTSVTSKVSPLHIGQHIMIADRNYCDLLDLPCVGTSSGSDRSYKEFLPGKPVALFLDQSEEALGHLLFPGQLYLMHPWNLLPYLTALDLALAISAAWPPALGLEACFFLSVRHTKVCVNLHYFCSLVADRSMLLQILLFLAPSFLGHQKILLVLSLTMWYEVIYIGERMSHLVYS

SEQ ID NO: 850116 - protein, 685 aa, Homo sapiens [sequence omitted]

SEQ ID NO: 850117 - protein, 641 aa, Homo sapiens
MRSITQGACRFIWEDKGYISGDHINLVSSSLSSFPILQRSSEEKILYSDRLSLERQKLTVCPIINGEDHLRLLNFQHNFITRIQNISNLQKLISLDLYDNQIEEISGLSTLRCLRVLLLGKNRIKKISNLENLKSLDVLDLHGNQITKIENINHLCELRVLNLARNFLSHVDNLNGLDSLTELNLRHNQITFVRDVDNLPCLQHLFLSFNNISSFDSVSCLADSSSLSDITFDGNPIAQESWYKHTVLQNMMQLRQLDMKRITEEERRMASVLAKKEEEKKRESHKQSLLKEKKRLTINNVARQWDLQQRVANIATNEDRKDSDSPQDPCQIDGSTLSAFPEETGPLDSGLNNALQGLSVIDTYLVEVDGDTLSLYGSGALESLDRNWSVQTAGMITTVSFTFIEFDEIVQVLPKLKIKFPNSLHLKFKETNLVMLQQFNALAQLRRIDQLTIDPQGNPVVNFTLWKYYVLFRLSHFSMQKINGTEVTQNDMIMAERLFGILAHVASSELPQYRLISILGDARKKQFRYLLESKGKKPGIINEENNDSKRLVGENTNRATLNYTTRDFYNEKLEEIKEKKKFCKTYIEDLVKEATEINMKNEALQKLWPQMFIELVRDAVIEIRNKNSYMKLCLQQITDQK

SEQ ID NO: 850118 - protein, 390 aa, Homo sapiens
MQLRQLDMKRITEEERRMASVLAKKEEEKKRESHKQSLLKEKKRLTINNVARQWDLQQRVANIATNEDRKDSDSPQDPCQIDGSTLSAFPEETGPLDSGLNNALQGLSVIDTYLVEVDGDTLSLYGSGALESLDRNWSVQTAGMITTVSFTFIEFDEIVQVLPKLKIKFPNSLHLKFKETNLVMLQQFNALAQLRRIDQLTIDPQGNPVVNFTLWKYYVLFRLSHFSMQKINGTEVTQNDMIMAERLFGILAHVASSELPQYRLISILGDARKKQFRYLLESKGKKPGIINEENNDSKRLVGENTNRATLNYTTRDFYNEKLEEIKEKKKFCKTYIEDLVKEATEINMKNEALQKLWPQMFIELVRDAVIEIRNKNSYMKLCLQQITDQK

SEQ ID NO: 850119 - protein, 477 aa, Homo sapiens
MIPGKYRSVSGRAANNVNCGLHLVIQTSSLPEKNKVEFKLNKDTSSFPGRLLQHDLERNYSSRQGDHINLVSSSLSSFPILQRSSEEKILYSDRLSLERQKLTVCPIINGEDHLRLLNFQHNFITRIQNISNLQKLISLDLYDNQIEEISGLSTLRCLRVLLLGKNRIKKISNLENLKSLDVLDLHGNQITKIENINHLCELRVLNLARNFLSHVDNLNGLDSLTELNLRHNQITFVRDVDNLPCLQHLFLSFNNISSFDSVSCLADSSSLSDITFDGNPIAQESWYKHTVLQNMMQLRQLDMKRITEEERRMASVLAKKEEEKKRESHKQSLLKEKKRLTINNVARQWDLQQRVANIATNEDRKDSDSPQDPCQIDGSTLSAFPEETGPLDSGLNNALQGLSVIDTYLVEVDGDTLSLYGSGALESLDRNWSVQTAGMITTVSFTFIEFDEIVQVLPKLKIKFPNSLHLKFKETIL

SEQ ID NO: 850120 - protein, 685 aa, Homo sapiens [sequence omitted]

SEQ ID NO: 850121 - protein, 85 aa, Homo sapiens
GGLVRNSDDGRRECFGEQEIKEKKKFCKTYIEDLVKEATEINMKNEALQKLWPQMFIELVRDAVIEIRNKNSYMKLCLQQITDQK

SEQ ID NO: 850122 - protein, 641 aa, Homo sapiens; identical to SEQ ID NO: 850117

SEQ ID NO: 850123 - protein, 685 aa, Homo sapiens [sequence omitted]

SEQ ID NO: 850124 - protein, 685 aa, Homo sapiens [sequence omitted]

SEQ ID NO: 850125 - protein, 142 aa, Homo sapiens
MSVEPPPELEEKAASEPEAGAMPEKRAGAQAAGSTWLQGFGPPSVYHAAIVIFLEFFAWGLLTTPMLTVLHETFSQHTFLMNGLIQGVKGLLSFLSAPLIGALSDVWGRKPFLLGTVFFTCFPIPLMRISPCFLKKKTHQWT

SEQ ID NO: 850126 - protein, 110 aa, Homo sapiens
MSVEPPPELEEKAASEPEAGAMPEKRAGAQAAGSTWVLHETFSQHTFLMNGLIQGVKGLLSFLSAPLIGALSDVWGRKPFLLGTVFFTCFPIPLMRISPCFLKKKTHQWT

SEQ ID NO: 850127 - protein, 132 aa, Homo sapiens [sequence omitted]

SEQ ID NO: 850128 - protein, 151 aa, Homo sapiens
MSVEPPPELEEKAASEPEAGAMPEKRAGAQAAGSTWLQGFGPPSVYHAAIVIFLEFFAWGLLTTPMLTVLHETFSQHTFLMNGLIQGVKGLLSFLSAPLIGALSDVWGRKPFLLGTVFFTCFPIPLMRISPCLCKYRIRDKRPYNMIFGMN

SEQ ID NO: 850129 - protein, 150 aa, Homo sapiens
MSVEPPPELEEKAASEPEAGAMPEKRAGAQAAGSTWLQGFGPPSVYHAAIVIFLEFFAWGLLTTPMLTVLHETFSQHTFLMNGLIQGVKGLLSFLSAPLIGALSDVWGRKPFLLGTVFFTCFPIPLMRISPCRVWWRAPVVPATCGRRMA

SEQ ID NO: 850130 - protein, 104 aa, Homo sapiens
DSFSRRELRCGVGPPTVQPAPDAAGNCDSRGRCGLLSGRFLELRSSASLIRSFSLRRLLSPRRRRLTRRPPRAAEPMRARAPPPPPRRRRRPGAPRAGAGMAAA

SEQ ID NO: 850131 - protein, 178 aa, Homo sapiens
MSVEPPPELEEKAASEPEAGAMPEKRAGAQAAGSTWLQGFGPPSVYHAAIVIFLEFFAWGLLTTPMLTVLHETFSQHTFLMNGLIQGVKGLLSFLSAPLIGALSDVWGRKPFLLGTVFFTCFPIPLMRISPWYFAMISVSGVFSVTFSVIFAYIADVTQEHERSTAYGWVSATFAASL

SEQ ID NO: 850132 - protein, 304 aa, Homo sapiens
MAEASAAGADSGAAVAAHRFFCHFCKGEVSPKLPEYICPRCESGFIEEVTDDSSFLGGGGSRIDNTTTTHFAELWGHLDHTMFFQDFRPFLSSSPLDQDNRANERGHQTHTDFWGARPPRLPLGRRYRSRGSSRPDRSPAIEGILQHIFAGFFANSAIPGSPHPFSWSGMLHSNPGDYAWGQTGLDAIVTQLLGQLENTGPPPADKEKITSLPTVTVTQEQVDMGLECPVCKEDYTVEEEVRQLPCNHFFHSSCIVPWLELHDTCPVCRKSLNGEDSTRQSQSTEASASNRFSNDSQLHDRWTF

SEQ ID NO: 850133 - protein, 223 aa, Homo sapiens
MFFQDFRPFLSSSPLDQDNRANERGHQTHTDFWGARPPRLPLGRRYRSRGSSRPDRSPAIEGILQHIFAGFFANSAIPGSPHPFSWSGMLHSNPGDYAWGQTGLDAIVTQLLGQLENTGPPPADKEKITSLPTVTVTQEQVDMGLECPVCKEDYTVEEEVRQLPCNHFFHSSCIVPWLELHDTCPVCRKSLNGEDSTRQSQSTEASASNRFSNDSQLHDRWTF

SEQ ID NO: 850134 - protein, 223 aa, Homo sapiens; identical to SEQ ID NO: 850133

SEQ ID NO: 850135 - protein, 223 aa, Homo sapiens; identical to SEQ ID NO: 850133

SEQ ID NO: 850136 - protein, 135 aa, Homo sapiens [sequence omitted]

SEQ ID NO: 850137 - protein, 330 aa, Homo sapiens
MAEASAAGADSGAAVAAHRFFCHFCKGEVSPKLPEYICPRCESGFIEEVTDDSSFLGGGGSRIDNTTTTHFAELWGHLDHTMFFQDFRPFLSSSPLDQDNRANERGHQTHTDFWGARPPRLPLGRRYRSRGSSRPDRSPAIEGILQHIFAGFFANSAIPGSPHPFSWSGMLHSNPGDYAWGQTGLDAIVTQLLGQLENTGPPPADKEKITSLPTVTVTQEQVDMGLECPVCKEDYTVEEEVRQLPCNHFFHSSCIVPWLELPCSCMYGRLSMGRTLPSGKPGAWGSCRHRLASRRLWPRLLESGPPDRWGTLLLAVHQLYGALCPPYASS

SEQ ID NO: 850138 - protein, 224 aa, Homo sapiens
MAEASAAGADSGAAVAAHRFFCHFCKGEVSPKLPEYICPRCESGFIEEVTDDSSFLGGGGSRIDNTTTTHFAELWGHLDHTMFFQDFRPFLSSSPLDQDNRANERGHQTHTDFWGARPPRLPLGRRYRSRGSSRPDRSPAIEGILQHIFAGFFANSAIPGSPHPFSWSGMLHSNPGDYAWGQTGLDAIVTQLLGQLENTGPPPADKEKITSLPTVTVTQEQVGS

SEQ ID NO: 850139 - protein, 120 aa, Homo sapiens
AGSEAVGRTEAAAAATTAAREVAAWRGTGRLPSRTAAAEGKNGGGFGGRGGLGRRCSRPPVFLPLLQGRGQPQTTGKSAVFSILGNLIDSWPRFPGTGSGAFCTSLTRPTSVCRIPAAHF

SEQ ID NO: 850140 - protein, 304 aa, Homo sapiens; identical to SEQ ID NO: 850132

SEQ ID NO: 850141 - protein, 271 aa, Homo sapiens
MIPESKVEGPFHNQEKLHILHFLGGGGSRIDNTTTTHFAELWGHLDHTMFFQDFRPFLSSSPLDQDNRANERGHQTHTDFWGARPPRLPLGRRYRSRGSSRPDRSPAIEGILQHIFAGFFANSAIPGSPHPFSWSGMLHSNPGDYAWGQTGLDAIVTQLLGQLENTGPPPADKEKITSLPTVTVTQEQVDMGLECPVCKEDYTVEEEVRQLPCNHFFHSSCIVPWLELHDTCPVCRKSLNGEDSTRQSQSTEASASNRFSNDSQLHDRWTF

SEQ ID NO: 850142 - protein, 266 aa, Homo sapiens
MGLKVNMTLLLNHRSSFLGGGGSRIDNTTTTHFAELWGHLDHTMFFQDFRPFLSSSPLDQDNRANERGHQTHTDFWGARPPRLPLGRRYRSRGSSRPDRSPAIEGILQHIFAGFFANSAIPGSPHPFSWSGMLHSNPGDYAWGQTGLDAIVTQLLGQLENTGPPPADKEKITSLPTVTVTQEQVDMGLECPVCKEDYTVEEEVRQLPCNHFFHSSCIVPWLELHDTCPVCRKSLNGEDSTRQSQSTEASASNRFSNDSQLHDRWTF

SEQ ID NO: 850143 - protein, 144 aa, Homo sapiens
MIPESKVEGPFHNQEKLHILHFLGGGGSRIDNTTTTHFAELWGHLDHTMFFQDFRPFLSSSPLDQDNRANERGHQTHTDFWGARPPRLPLGRRYRSRGSSRPDRSPAIEGILQHIFAGFFANSAIPGSPHPFSCMTHVLYVGRA

SEQ ID NO: 850144 - protein, 245 aa, Homo sapiens
MAEASAAGADSGAAVAAHRFFCHFCKGEVSPKLPEYICPRCESGFIEEVTDDSSFLGGGGSRIDNTTTTHFAELWGHLDHTMFFQDFRPFLSSSPLDQDNRANERGHQTHTDFWGARPPRLPLGRRYRSRGSSRPDRSPAIEGILQHIFAGFFANSAIPGSPHPFSWSGMLHSNPGDYAWGQTGLDAIVTQLLGQLENTGPPPADKEKITSLPTVTVTQEQVDMGLECPGENVFSLWAPALMGWG

SEQ ID NO: 850145 - protein, 229 aa, Homo sapiens
MAEASAAGADSGAAVAAHRFFCHFCKGEVSPKLPEYICPRCESGFIEEVTDDSSFLGGGGSRIDNTTTTHFAELWGHLDHTMFFQDFRPFLSSSPLDQDNRANERGHQTHTDFWGARPPRLPLGRRYRSRGSSRPDRSPAIEGILQHIFAGFFANSAIPGSPHPFSWSGMLHSNPGDYAWGQTGLDAIVTQVRSCLLRVSVQCVSWFHRLPAFLLLLSEMAVTLLSLIF

SEQ ID NO: 850146 - protein, 205 aa, Homo sapiens
KHSCFLFAFSCFGPATKGGFHTIAFDSGGAGTGGLGHSPAAPTLGHGLSEQAVASAFSGNQQLLFGEFVQMLACQHSFKSGNHAFRPACVLILAGILTNGKKKAVPRRSRQGLFLATGPGLLMISPLLQACMKISCCSHDLKKEVDLLQHLQVSPPVSGLQKVVLDVLRHALSWLEEVEQLLRDLGILPSSPNKGYWDFFSHMVA

SEQ ID NO: 850147 - protein, 240 aa, Homo sapiens
ISALQKGYSKVLCQTLSERNSEITSLKNEGENLKRDNAITSGMVSSLQKDILAKDEQVQQLKEEVSHLKSQNKDKDHQLEALGSRLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKGYWDFFSHMVA

SEQ ID NO: 850148 - protein, 178 aa, Homo sapiens
METLPPLAGPCCPPDTVAPSLLQLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKGYWDFFSHMVA

SEQ ID NO: 850149 - protein, 364 aa, Homo sapiens
MIGSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 850150 - protein, 733 aa, Homo sapiens
MTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSDSPSSVVNKQLGSMSLDEQQDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 850151 - protein, 959 aa, Homo sapiens
APLYRGAGGRWPAGLGHRRPTSPPRDRWQPGGSVAVFSSLADNEGELVTFPATTTRVRLSPGVPFPRLSLPAVNRKAAARAPRRLRGRRLPTASPRSASGPRQEEGGAMATGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSDSPSSVVNKQLGSMSLDEQQDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 850152 - protein, 733 aa, Homo sapiens; identical to SEQ ID NO: 850150

SEQ ID NO: 850153 - protein, 733 aa, Homo sapiens; identical to SEQ ID NO: 850150

SEQ ID NO: 850154 - protein, 937 aa, Homo sapiens
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSEFLRGPEIALLRKRLQQLRLKKAEQQRQQELAAHTQQQPSTSDQSSHEGSSQDPHASDSPSSVVNKQLGSMSLDEQQDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 850155 - protein, 880 aa, Homo sapiens
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSDSPSSVVNKQLGSMSLDEQQDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 850156 - protein, 420 aa, Homo sapiens
CAVVVNYMVRFFVNLTEQQDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 850157 - protein, 860 aa, Homo sapiens
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 850158 - protein, 364 aa, Homo sapiens; identical to SEQ ID NO: 850149

SEQ ID NO: 850159 - protein, 685 aa, Homo sapiens
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDALLLPVFRSSSDGEKKGKKWKNWIL

SEQ ID NO: 850160 - protein, 561 aa, Homo sapiens
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSDNNNEKLSPKPGTGEPVLSLHYSTEGTTTSTIKLNFTDEWSSIASSSRGIGSHCKSEGQEESFVPQSSVQPPEGDSETKLLKNHQRMRHYQGVSASCSELMT

SEQ ID NO: 850161 - protein, 414 aa, Homo sapiens
KNSARVRRGFSSEVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSVLLLLWLTNSSDPCHLTSNRITIMKS

SEQ ID NO: 850162 - protein, 880 aa, Homo sapiens; identical to SEQ ID NO: 850155

SEQ ID NO: 850163 - protein, 882 aa, Homo sapiens
AEFRAGASPSQAPCACCQPPPLLGFSRRAGPWAEGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSDSPSSVVNKQLGSMSLDEQQDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 850164 - protein, 860 aa, Homo sapiens; identical to SEQ ID NO: 850157

SEQ ID NO: 850165 - protein, 462 aa, Homo sapiens
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSGAV

SEQ ID NO: 850166 - protein, 408 aa, Homo sapiens [sequence omitted]

SEQ ID NO: 850167 - protein, 860 aa, Homo sapiens; identical to SEQ ID NO: 850157

SEQ ID NO: 850168 - protein, 305 aa, Homo sapiens
TTCYIQLYFLTAQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 850169 - protein, 731 aa, Homo sapiens
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMVPNVHGIFW

SEQ ID NO: 850170 - protein, 680 aa, Homo sapiens
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRLVNF

SEQ ID NO: 850171 - protein, 529 aa, Homo sapiens
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSEFLRGPEIALLRKRLQQLRLKKAEQQRQQELAAHTQQQPSTSDQSSHEGSSQDPHASGPLKSWVAGSCSE

SEQ ID NO: 850172 - protein, 102 aa, Homo sapiens [sequence omitted]

SEQ ID NO: 850173 - protein, 496 aa, Homo sapiens
MRVLSGTSLMLCSLLLLLQALCSPGLAPQSRGHLCRTRPTDLVFVVDSSRSVRPVEFEKVKVFLSQVIESLDVGPNATRVGMVNYASTVKQEFSLRAHVSKAALLQAVRRIQPLSTGTMTGLAIQFAITKAFGDAEGGRSRSPDISKVVIVVTDGRPQDSVQDVSARARASGVELFAIGVGSVDKATLRQIASEPQDEHVDYVESYSVIEKLSRKFQEAFCVVSDLCATGDHDCEQVCISSPGSYTCACHEGFTLNSDGKTCNVCSGGGGSSATDLVFLIDGSKSVRPENFELVKKFISQIVDTLDVSDKLAQVGLVQYSSSVRQEFPLGRFHTKKDIKAAVRNMSYMEKGTMTGAALKYLIDNSFTVSSGARPGAQKVGIVFTDGRSQDYINDAAKKAKDLGFKMFAVGVGNAVEDELREIASEPVAEHYFYTADFKTINQIGKKLQKKICVEEDPCACESLVKFQAKVEGLLQALTRKLEAVSKRLAILENTVV

SEQ ID NO: 850174 - protein, 444 aa, Homo sapiens
MALTLETPIWRWGITSLRASQSCLPEGGEQMESPPATSLSQRKRVSSSASRVLFPRVPPGCATRQSSRLSGPQPPLLDSPVGFREPGVTPPRVSQVVIVVTDGRPQDSVQDVSARARASGVELFAIGVGSVDKATLRQIASEPQDEHVDYVESYSVIEKLSRKFQEAFCVVSDLCATGDHDCEQVCISSPGSYTCACHEGFTLNSDGKTCNVCSGGGGSSATDLVFLIDGSKSVRPENFELVKKFISQIVDTLDVSDKLAQVGLVQYSSSVRQEFPLGRFHTKKDIKAAVRNMSYMEKGTMTGAALKYLIDNSFTVSSGARPGAQKVGIVFTDGRSQDYINDAAKKAKDLGFKMFAVGVGNAVEDELREIASEPVAEHYFYTADFKTINQIGKKLQKKICVEEDPCACESLVKFQAKVEGLLQALTRKLEAVSKRLAILENTVV

SEQ ID NO: 850175 - protein, 1068 aa, Homo sapiens
LSAGRVLAMASALNSKINPPGTCQGSKADGGAGWRMDCDPQMHVKMCKKIAQLTKVIYALNTRQDEAEASMEALREAHQEELQNAVAETKARLLQEQGCAEEEALLQRIQALESALELQKRLTEEALAESASCRLETKERELRVEAEHAERVLTLSREMLELKADYERRLQHLTSHEATPQGRLPQESPETKSEPGQGPEMQEVLLEVQRLRVENQQLSKDYARKAEELQATYERENEAIRQAMQQSVSQALWQWQEKESDLRKNFQVQESALQAQVRKLEGDLEHRGRKISDLKKYAQKLKERIQDLDVQLKEARQENSELKGTAKKLGEKLAVAKDRMMLQECRGTQQTDAMKTELVSENKVLREENDLEAGNLHPQQDQSCLKECPCMKGGTDMQTKKEASAETEYMKQQYEEDLRKIKHQTEEEKKHLKDQLVKRLEDLVKKHTVEIKSVRSSVEAERKKLQREVEAQLEEVRKKSEKEIKQLEEEKAALNVKLQNSLLEVLRLEEFIQQNKTRPTGAEESPQELGRQHCSILETQDPCLKLDETSPRGEEYQDKLAAEEGTSSDEEERTKVLLKEGSDPQPPLGSLLKEKTSKIQRLEEDWQSQKAKLQAQVSQMQQALEQCTSNYREDLQALKQLSDLEREKLQRELQETTQQNHAMKAQLEASHQRALRMLEKARHQELKATEERLKKESSHSLQIQHQTHRLELQALEEKARQELQEERERMQAQQALLLESLRQELSEQQAACSGHQKDLEALQAELRALGRQQASSQCPGDSKDHIIATEERGGPGQAGSPPGAAGQGSGEGCGLWEENAQLQDAVRRLRAEVEQHQQEAQKLRDQRRFLEETQQAQRAREVETLRQEHRKEMQAMVADFSSAQAQLQARLAALEAELKDSGEKPGKGASRPEDLQLIGRLQTRLKEREDIIKQLTEERRFHYAAFPSAMSHRNRSFSFNPHPGYLTPSMKKKKVEDVPSRVVSVPNLASYAKNFLSGDLSSRINAPPITTSPSLDPSPSCGRTYKPNQSTDAKTATRTPDGETAQAKEAQQKQGSPHQEWFTKYFSF

SEQ ID NO: 850176 - protein, 698 aa, Homo sapiens
MFTVLTLLSVHTDLSYLLTEQCDLTRLNNNFWGQNIFSVFGAGPEGGPQTNVNSMHCQIFAALNKTLNNWAIKMVDLYVIFHRKVKLDEDSLEIESSVHINLNHTILKKKKLITYNCQTYVLKVNLLPESKRGSNAFLNANKHLSPYINTPYCFSLPNIFCEFPAESVLVRSGCSNKISYLYWIIYKNRNMSLTVLEAKSKIKAPADMESGEGPFFRNGCLLRVLTWWKRQERLPEPLLKGTYPTHEGEALMTPLLPKSPTSEYYYIDIRFQHMNFGRDINIQDIAVNPVGLLFILCFQKDYIQVVLFLCVETLSQAALCISVLKLSMIPGQGENFTELRSYIGFDSFLAAGDLKRSFSLKFLNSTRNDYIFVNKIFACFHNFLLRPYALGIEVKAFKDTNLSFLFVITKLPFRKFLTIYTLTSSKCTYCALTLLTKKYNLIDKTFYFSLHNDSINLSTAERSRDDSDGVEVTVKMKRNIQFGIKLRERKKQYLMVNLFRLYYDRGGRVNMFLQQNWKEYYLFHMKANCFVIGVGKNGFTQSMAAHHIPEPLTALTLMYISNPTFVIEATWLIFLQDPSGFCRGGWQIKWNYDRDHLTVSVRFPRVALISTVTSPPPLGYSTVCLFLRRSLALSPKLGCSGAISAHCNLGLPGSSDSPASASRVAGTTGTRHQLINVFLVETGFHHVGQAGHELLTSK

SEQ ID NO: 850177 - protein, 1068 aa, Homo sapiens; identical to SEQ ID NO: 850175

SEQ ID NO: 850178 - protein, 90 aa, Homo sapiens
DPCLKLDETSPRGEEYQDKLAAEEGTSSDEEERYRRTCRLLSAPLNEDSDVEGFIHSFILSSSIYHCSLQHAWGGNKHILYVFSTAMGFT

SEQ ID NO: 850179 - protein, 184 aa, Homo sapiens [sequence omitted]

SEQ ID NO: 850180 - protein, 873 aa, Homo sapiens
VGGLLRLKHKRLEAELAAHEPAIQGVLDTGKKLSDDNTIGKEERIQDLDVQLKEARQENSELKGTAKKLGEKLAVAKDRMMLQECRGTQQTDAMKTELVSENKVLREENDLEAGNLHPQQDQSCLKECPCMKGGTDMQTKKEASAETEYMKQQYEEDLRKIKHQTEEEKKHLKDQLVKRLEDLVKKHTVEIKSVRSSVEAERKKLQREVEAQLEEVRKKSEKEIKQLEEEKAALNVKLQNSLLEVLRLEEFIQQNKTRPTGAEESPQELGRQHCSILETQDPCLKLDETSPRGEEYQDKLAAEEGTSSDEEERTKVLLKEGSDPQPPLGSLLKEKTSKIQRLEEDWQSQKAKLQAQVSQMQQALEQCTSNYREDLQALKQLSDLEREKLQRELQETTQQNHAMKAQLEASHQRALRMLEKARHQELKATEERLKKESSHSLQIQHQTHRLELQALEEKARQELQEERERMQAQQALLLESLRQELSEQQAACSGHQKDLEALQAELRALGRQQASSQCPGDSKDHIIATEERGGPGQAGSPPGAAGQGSGEGCGLWEENAQLQDAVRRLRAEVEQHQQEAQKLRDQRRFLEETQQAQRAREVETLRQEHRKEMQAMVADFSSAQAQLQARLAALEAELKDSGEKPGKGASRPEDLQLIGRLQTRLKEREDIIKQLTEERRFHYAAFPSAMSHRNRSFSFNPHPGYLTPSMKKKKVEDVPSRVVSVPNLASYAKNFLSGDLSSRINAPPITTSPSLDPSPSCGRTYKPNQSTDAKTATRFGGCWGQGPLFYFPVDKRGSRILSSTWYQIPEGLFSWMIRQGTLNHLPENFSMGYTKGGLHLAWRSEFKLQSSSFLALWPWTGHLTSPGLHIPCL

SEQ ID NO: 850181 - protein, 78 aa, Homo sapiens
VRSPTLMPTFMPSCSHFFPQATEERLKKESSHSLQIQHQTHRLELQALEEKARQELQEERERMQAQQALLLGIHPIVY

SEQ ID NO: 850182 - protein, 110 aa, Homo sapiens
MAAVVAKREGPPFISEAAVRGNAAVLDYCRTSVSALSGATAGILGLTGLYGFIFYLLASVLLSLLLILKAGRRWNKYFKSRRPLFTGGLIGGLFTYVLFWTFLYGMVHVY

SEQ ID NO: 850183 - protein, 110 aa, Homo sapiens; identical to SEQ ID NO: 850182

SEQ ID NO: 850184 - protein, 110 aa, Homo sapiens; identical to SEQ ID NO: 850182

SEQ ID NO: 850185 - protein, 110 aa, Homo sapiens; identical to SEQ ID NO: 850182

SEQ ID NO: 850186 - protein, 100 aa, Homo sapiens
MAAVVAKREGPPFISEAAVRGNAAVLDYCRTSVSALSGATAGILGLTGLYGFIFYLLASVLLSLLLILKAGRRWNKYFKSRRACNICSTPCSSFSRREGG

SEQ ID NO: 850187 - protein, 110 aa, Homo sapiens; identical to SEQ ID NO: 850182

SEQ ID NO: 850188 - protein, 110 aa, Homo sapiens; identical to SEQ ID NO: 850182

SEQ ID NO: 850189 - protein, 110 aa, Homo sapiens; identical to SEQ ID NO: 850182

SEQ ID NO: 850190 - protein, 939 aa, Homo sapiens
GRARADQRITESRQVVELAVKEHKAEILALQQALKEQKLKAESLSDKLNDLEKKHAMLEMNARSLQQKLETERELKQRLLEEQAKLQQQMDLQKNHIFRLTQGLQEALDRADLLKTERSDLEYQLENIQVLYSHEKVKMEGTISQQTKLIDFLQAKMDQPAKKKKVPLQYNELKLALEKEKARCAELEEALQKTRIELRSAREEAAHRKATDHPHPSTPATARQQIAMSAIVRSPEHQPSAMSLLAPPSSRRKESSTPEEFSRRLKERMHHNIPHRFNVGLNMRATKCAVCLDTVHFGRQASKCLECQVMCHPKCSTCLPATCGLPAEYATHFTEAFCRDKMNSPGLQTKEPSSSLHLEGWMKVPRNNKRGQQGWDRKYIVLEGSKVLIYDNEAREAGQRPVEEFELCLPDGDVSIHGAVGASELANTAKADVPYILKMESHPHTTCWPGRTLYLLAPSFPDKQRWVTALESVVAGGRVSREKAEADAKLLGNSLLKLEGDDRLDMNCTLPFSDQVVLVGTEEGLYALNVLKNSLTHVPGIGAVFQIYIIKDLEKLLMIAGEERALCLVDVKKVKQSLAQSHLPAQPDISPNIFEAVKGCHLFGAGKIENGLCICAAMPSKVVILRYNENLSKYCIRKEIETSEPCSCIHFTNYSILIGTNKFYEIDMKQYTLEEFLDKNDHSLAPAVFAASSNSFPVSIVQVNSAGQREEYLLCFHEFGVFVDSYGRRSRTDDLKWSRLPLAFAYREPYLFVTHFNSLEVIEIQARSSAGTPARAYLDIPNPRYLGPAISSGAIYLASSYQDKLRVICCKGNLVKESGTEHHRGPSTSRSSPNKRGPPTYNEHITKRVASSPAPPEGPSHPREPSTPHRYREGRTELRRDKSPGRPLEREKSPGRMLSTRRERSPGRLFEDSSRGRLPAGAVRTPLSQVNKVWDQSSV

SEQ ID NO: 850191 - protein, 999 aa, Homo sapiens
GAEQIADLGVRRAASGEMLKFKYGARNPLDAGAAEPIASRASRLNLFFQGKPPFMTQQQMSPLSREGILDALFVLFEECSQPALMKIKHVSNFVRKYSDTIAELQELQPSAKDFEVRSLVGCGHFAEVQVVREKATGDIYAMKVMKKKALLAQEQVSFFEEERNILSRSTSPWIPQLQYAFQDKNHLYLVLYSHEKVKMEGTISQQTKLIDFLQAKMDQPAKKKKVPLQYNELKLALEKEKARCAELEEALQKTRIELRSAREEAAHRKATDHPHPSTPATARQQIAMSAIVRSPEHQPSAMSLLAPPSSRRKESSTPEEFSRRLKERMHHNIPHRFNVGLNMRATKCAVCLDTVHFGRQASKCLECQVMCHPKCSTCLPATCGLPAEYATHFTEAFCRDKMNSPGLQTKEPSSSLHLEGWMKVPRNNKRGQQGWDRKYIVLEGSKVLIYDNEAREAGQRPVEEFELCLPDGDVSIHGAVGASELANTAKADVPYILKMESHPHTTCWPGRTLYLLAPSFPDKQRWVTALESVVAGGRVSREKAEADAKLLGNSLLKLEGDDRLDMNCTLPFSDQVVLVGTEEGLYALNVLKNSLTHVPGIGAVFQIYIIKDLEKLLMIAGEERALCLVDVKKVKQSLAQSHLPAQPDISPNIFEAVKGCHLFGAGKIENGLCICAAMPSKVVILRYNENLSKYCIRKEIETSEPCSCIHFTNYSILIGTNKFYEIDMKQYTLEEFLDKNDHSLAPAVFAASSNSFPVSIVQVNSAGQREEYLLCFHEFGVFVDSYGRRSRTDDLKWSRLPLAFAYREPYLFVTHFNSLEVIEIQARSSAGTPARAYLDIPNPRYLGPAISSGAIYLASSYQDKLRVICCKGNLVKESGTEHHRGPSTSRSSPNKRGPPTYNEHITKRVASSPAPPEGPSHPREPSTPHRYREGRTELRRDKSPGRPLEREKSPGRMLSTRRERSPGRLFEDSSRGRLPAGAVRTPLSQVNKVWDQSSV

SEQ ID NO: 850192 - protein, 981 aa, Homo sapiens
GAEQIADLGVRRAASGEMLKFKYGARNPLDAGAAEPIASRASRLNLFFQGKPPFMTQQQMSPLSREGILDALFVLFEECSQPALMKIKHVSNFVRKYSDTIAELQELQPSAKDFEVRSLVGCGHFAEVQVVREKATGDIYAMKVMKKKALLAQEQVSFFEEERNILSRSTSPWIPQLQYAFQDKNHLYLVLYSHEKVKMEGTISQQTKLIDFLQAKMDQPAKKKKVPLQYNELKLALEKEKARCAELEEALQKTRIELRSAREEAAHRKATDHPHPSTPATARQQIAMSAIVRSPEHQPSAMSLLAPPSSRRKESSTPEEFSRRLKERMHHNIPHRFNVGLNMRATKCAVCLDTVHFGRQASKCLECQVMCHPKCSTCLPATCGLPAEYATHFTEAFCRDKMNSPGLQTKEPSSSLHLEGWMKVPRNNKRGQQGWDRKYIVLEGSKVLIYDNEAREAGQRPVEEFELCLPDGDVSIHGAVGASELANTAKADVPYILKMESHPHTTCWPGRTLYLLAPSFPDKQRWVTALESVVAGGRVSREKAEADAKLLGNSLLKLEGDDRLDMNCTLPFSDQVVLVGTEEGLYALNVLKNSLTHVPGIGAVFQIYIIKDLEKLLMIAGEERALCLVDVKKVKQSLAQSHLPAQPDISPNIFEAVKGCHLFGAGKIENGLCICAAMPSKVVILRYNDCIHFTNYSILIGTNKFYEIDMKQYTLEEFLDKNDHSLAPAVFAASSNSFPVSIVQVNSAGQREEYLLCFHEFGVFVDSYGRRSRTDDLKWSRLPLAFAYREPYLFVTHFNSLEVIEIQARSSAGTPARAYLDIPNPRYLGPAISSGAIYLASSYQDKLRVICCKGNLVKESGTEHHRGPSTSRSSPNKRGPPTYNEHITKRVASSPAPPEGPSHPREPSTPHRYREGRTELRRDKSPGRPLEREKSPGRMLSTRRERSPGRLFEDSSRGRLPAGAVRTPLSQVNKVWDQSSV

SEQ ID NO: 850193 - protein, 784 aa, Homo sapiens
GAEQIADLGVRRAASGEMLKFKYGARNPLDAGAAEPIASRASRLNLFFQGKPPFMTQQQMSPLSREGILDALFVLFEECSQPALMKIKHVSNFVRKYSDTIAELQELQPSAKDFEVRSLVGCGHFAEVQVVREKATGDIYAMKVMKKKALLAQEQVSFFEEERNILSRSTSPWIPQLQYAFQDKNHLYLVLYSHEKVKMEGTISQQTKLIDFLQAKMDQPAKKKKVPLQYNELKLALEKEKARCAELEEALQKTRIELRSAREEAAHRKATDHPHPSTPATARQQIAMSAIVRSPEHQPSAMSLLAPPSSRRKESSTPEEFSRRLKERMHHNIPHRFNVGLNMRATKCAVCLDTVHFGRQASKCLECQVMCHPKCSTCLPATCGLPAEYATHFTEAFCRDKMNSPGLQTKEPSSSLHLEGWMKVPRNNKRGQQGWDRKYIVLEGSKVLIYDNEAREAGQRPVEEFELCLPDGDVSIHGAVGASELANTAKADVPYILKMESHPHTTCWPGRTLYLLAPSFPDKQRWVTALESVVAGGRVSREKAEADAKLLGNSLLKLEGDDRLDMNCTLPFSDQVVLVGTEEGLYALNVLKNSLTHVPGIGAVFQIYIIKDLEKLLMIAGEERALCLVDVKKVKQSLAQSHLPAQPDISPNIFEAVKGCHLFGAGKIENGLCICAAMPSKVVILRYNENLSKYCIRKEIETSEPCSCIHFTNYSILIGTNKFYEIDMKQYTLEEFLDNTFARDNTFARDNTFARDNTFARDNTFARDNTFARDNTFARDNTFA

SEQ ID NO: 850194 - protein, 563 aa, Homo sapiens
GAEQIADLGVRRAASGEMLKFKYGARNPLDAGAAEPIASRASRLNLFFQGKPPFMTQQQMSPLSREGILDALFVLFEECSQPALMKIKHVSNFVRKYSDTIAELQELQPSAKDFEVRSLVGCGHFAEVQVVREKATGDIYAMKVMKKKALLAQEQVSFFEEERNILSRSTSPWIPQLQYAFQDKNHLYLVLYSHEKVKMEGTISQQTKLIDFLQAKMDQPAKKKKVPLQYNELKLALEKEKARCAELEEALQKTRIELRSAREEAAHRKATDHPHPSTPATARQQIAMSAIVRSPEHQPSAMSLLAPPSSRRKESSTPEEFSRRLKERMHHNIPHRFNVGLNMRATKCAVCLDTVHFGRQASKCLECQVMCHPKCSTCLPATCGLPAEYATHFTEAFCRDKMNSPGLQTKEPSSSLHLEGWMKVPRNNKRGQQGWDRKYIVLEGSKVLIYDNEAREAGQRPVEEFELCLPDGDVSIHGAVGASELANTAKADVPYILKMESHPHTTCWPGRTLYLLAPSFPDKQRWVTALESVVAGGRVSREKAEADAVSMKAGPGGCLCKGG

SEQ ID NO: 850195 - protein, 898 aa, Homo sapiens
MLEMNARSLQQKLETERELKQRLLEEQAKLQQQMDLQKNHIFRLTQGLQEALDRADLLKTERSDLEYQLENIQVLYSHEKVKMEGTISQQTKLIDFLQAKMDQPAKKKKGLFSRRKEDPALPTQVPLQYNELKLALEKEKARCAELEEALQKTRIELRSAREEAAHRKATDHPHPSTPATARQQIAMSAIVRSPEHQPSAMSLLAPPSSRRKESSTPEEFSRRLKERMHHNIPHRFNVGLNMRATKCAVCLDTVHFGRQASKCLECQVMCHPKCSTCLPATCGLPAEYATHFTEAFCRDKMNSPGLQTKEPSSSLHLEGWMKVPRNNKRGQQGWDRKYIVLEGSKVLIYDNEAREAGQRPVEEFELCLPDGDVSIHGAVGASELANTAKADVPYILKMESHPHTTCWPGRTLYLLAPSFPDKQRWVTALESVVAGGRVSREKAEADAKLLGNSLLKLEGDDRLDMNCTLPFSDQVVLVGTEEGLYALNVLKNSLTHVPGIGAVFQIYIIKDLEKLLMIAGEERALCLVDVKKVKQSLAQSHLPAQPDISPNIFEAVKGCHLFGAGKIENGLCICAAMPSKVVILRYNENLSKYCIRKEIETSEPCSCIHFTNYSILIGTNKFYEIDMKQYTLEEFLDKNDHSLAPAVFAASSNSFPVSIVQVNSAGQREEYLLCFHEFGVFVDSYGRRSRTDDLKWSRLPLAFAYREPYLFVTHFNSLEVIEIQARSSAGTPARAYLDIPNPRYLGPAISSGAIYLASSYQDKLRVICCKGNLVKESGTEHHRGPSTSRSSPNKRGPPTYNEHITKRVASSPAPPEGPSHPREPSTPHRYREGRTELRRDKSPGRPLEREKSPGRMLSTRRERSPGRLFEDSSRGRLPAGAVRTPLSQVNKVWDQSSV

SEQ ID NO: 850196 - protein, 66 aa, Homo sapiens
SPVLGNILIGDRLHNIRSDEQVGSKVDPFPPQQVNMTVFSTVSTVQIPFQIATWPASQLLPARVLT

SEQ ID NO: 850197 - protein, 206 aa, Homo sapiens
GAEQIADLGVRRAASGEMLKFKYGARNPLDAGAAEPIASRASRLNLFFQGKPPFMTQQQMSPLSREGILDALFVLFEECSQPALMKIKHVSNFVRKYSDTIAELQELQPSAKDFEVRSLVGCGHFAEVQVVREKATGDIYAMKVMKKKALLAQEQVSFFEEERNILSRSTSPWIPQLQYAFQDKNHLYLVMEYQPGGDLLSLLNRY

SEQ ID NO: 850198 - protein, 222 aa, Homo sapiens
MCLRLGGLSVGDFRKVLMKTGLVLVVLGHVSFITAALFHGTVLRYVGTPQDAVALQYCVVNILSVTSAIVVITSGIAAIVLSRYLPSTPLRWTVFSSSVACALLSLTCALGLLASIAMTFATQGKALLAACTFGSSELLALAPDCPFDPTRIYSSSLCLWGIALVLCVAENVFAVRCAQLTHQLLELRPWWGKSSHHMMRENPELVEGRDLLSCTSSEPLTL

SEQ ID NO: 850199 - protein, 222 aa, Homo sapiens; identical to SEQ ID NO: 850198

SEQ ID NO: 850200 - protein, 222 aa, Homo sapiens; identical to SEQ ID NO: 850198

SEQ ID NO: 850201 - protein, 189 aa, Homo sapiens
MCLRLGGLSVGDFRKVLMKTGLVLVVLGHVSFITAALFHGTVLRYVGTPQDAVALQYCVVNILSVTSAIVVITSGIAAIVLSRYLPSTPLGKALLAACTFGSSELLALAPDCPFDPTRIYSSSLCLWGIALVLCVAENVFAVRCAQLTHQLLELRPWWGKSSHHMMRENPELVEGRDLLSCTSSEPLTL

SEQ ID NO: 850202 - protein, 202 aa, Homo sapiens
MCLRLGGLSVGDFRKVLMKTGLVLVVLGHVSFITAALFHGTVLRYVGTPQDAVALQYCVVNILSVTSAIVRWTVFSSSVACALLSLTCALGLLASIAMTFATQGKALLAACTFGSSELLALAPDCPFDPTRIYSSSLCLWGIALVLCVAENVFAVRCAQLTHQLLELRPWWGKSSHHMMRENPELVEGRDLLSCTSSEPLTL

SEQ ID NO: 850203 - protein, 169 aa, Homo sapiens
MCLRLGGLSVGDFRKVLMKTGLVLVVLGHVSFITAALFHGTVLRYVGTPQDAVALQYCVVNILSVTSAIVGKALLAACTFGSSELLALAPDCPFDPTRIYSSSLCLWGIALVLCVAENVFAVRCAQLTHQLLELRPWWGKSSHHMMRENPELVEGRDLLSCTSSEPLTL

SEQ ID NO: 850204 - protein, 260 aa, Homo sapiens
MCLRLGGLSVGDFRKVLMKTGLVLVVLGHVSFITAALFHGTVLRYVGTPQDAVALQYCVVNILSVTSAIVVITSGIAAIVLSRYLPSTPLRWTVFSSSVACALLSLTCALGLLASIAMTFATQGKALLAACTFGSSELLALAPDCPFDPTRIYVVPRPGVGAPGPRTGGKGSWNPPSTPNSSQPSLPHAPQSSSLCLWGIALVLCVAENVFAVRCAQLTHQLLELRPWWGKSSHHMMRENPELVEGRDLLSCTSSEPLTL

SEQ ID NO: 850205 - protein, 105 aa, Homo sapiens [sequence omitted]

SEQ ID NO: 850206 - protein, 136 aa, Homo sapiens
GSKSFRNTFRTQCPSLGPGPQLPLLPSRISPTHSPDKLSPTGGLSVGDFRKVLMKTGLVLVVLGHVSFITAALFHGTVLRYVGTPQDAVALQYCVVNILSVTSAIVVWPGWEGGWWEEAGGGLKGLQQVPTQSLWW

SEQ ID NO: 850207 - protein, 222 aa, Homo sapiens; identical to SEQ ID NO: 850198

SEQ ID NO: 850208 - protein, 222 aa, Homo sapiens; identical to SEQ ID NO: 850198

SEQ ID NO: 850209 - protein, 105 aa, Homo sapiens
MTFATQGKALLAACTFGSSELLALAPDCPFDPTRIYSSSLCLWGIALVLCVAENVFAVRCAQLTHQLLELRPWWGKSSHHMMRENPELVEGRDLLSCTSSEPLTL

SEQ ID NO: 850210 - protein, 222 aa, Homo sapiens; identical to SEQ ID NO: 850198

SEQ ID NO: 850211 - protein, 177 aa, Homo sapiens
MCLRLGGLSVGDFRKVLMKTGLVLVVLGHVSFITAALFHGTVLRYRWTVFSSSVACALLSLTCALGLLASIAMTFATQGKALLAACTFGSSELLALAPDCPFDPTRIYSSSLCLWGIALVLCVAENVFAVRCAQLTHQLLELRPWWGKSSHHMMRENPELVEGRDLLSCTSSEPLTL

SEQ ID NO: 850212 - protein, 136 aa, Homo sapiens
MCLRLGGLSVGDFRKVLMKTGLVLVVLGHVSFITAALFHGTVLRYVGTPQDAVALQYCVVNILSVTSAIVVITSGIAAIVLSRYLPSTPLGKALLAACTFGSSELLALAPAAGAEALVGEKQPPHDAGEPRAGGGP

SEQ ID NO: 850213 - protein, 373 aa, Homo sapiens
MPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGERLGEDPYYTENGGGQGYSSGPGTSPEAQGKASVNRGAQENGTGQATSRNGHSARQHVVADTEL

SEQ ID NO: 850214 - protein, 316 aa, Homo sapiens
MPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGERLELEP

SEQ ID NO: 850215 - protein, 373 aa, Homo sapiens; identical to SEQ ID NO: 850213

SEQ ID NO: 850216 - protein, 373 aa, Homo sapiens; identical to SEQ ID NO: 850213

SEQ ID NO: 850217 - protein, 336 aa, Homo sapiens
MPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGERLDAASLPKAPIEEASSHHSIIHQVL

SEQ ID NO: 850218 - protein, 48 aa, Homo sapiens
MLKQRLRPRGQEPVAHHRKSESRHSHTRDVSADVKLLPLMHQDVDFLF

SEQ ID NO: 850219 - protein, 1025 aa, Homo sapiens
DGLSTGACQALAEVHAPLGGPRPRLCALAAEGHFLGHSWTGSRAGAHTGAPAWPSRRLRDLPAGGMWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFEKIRKALPSSEDLVKLAPDFDKIVESLSLLKDFFTSGSPEETAFRATDRGSESDKHFRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKVREIQEKLDAFIEALHQEK

SEQ ID NO: 850220 - protein, 1062 aa, Homo sapiens
DGLSTGACQALAEVHAPLGGPRPRLCALAAEGHFLGHSWTGSRAGAHTGAPAWPSRRLRDLPAGGMWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFEKIRKALPSSEDLVKLAPDFDKIVESLSLLKDFFTSGSPEETAFRATDRGSESDKHFRKGLLGELILLQQQIQEHEEEARRAAGQYSTSYAQQKRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKVREIQEKLDAFIEALHQEK

SEQ ID NO: 850221 - protein, 694 aa, Homo sapiens
MYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKVREIQEKLDAFIEALHQEK

SEQ ID NO: 850222 - protein, 1062 aa, Homo sapiens; identical to SEQ ID NO: 850220

SEQ ID NO: 850223 - protein, 1062 aa, Homo sapiens; identical to SEQ ID NO: 850220

SEQ ID NO: 850224 - protein, 1062 aa, Homo sapiens; identical to SEQ ID NO: 850220

SEQ ID NO: 850225 - protein, 1166 aa, Homo sapiens
DGLSTGACQALAEVHAPLGGPRPRLCALAAEGHFLGHSWTGSRAGAHTGAPAWPSRRLRDLPAGGMWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFEKIRKALPSSEDLVKLAPDFDKIVESLSLLKDFFTSGSPEETAFRATDRGSESDKHFRKGLLGELILLQQQIQEHEEEARRAAGQYSTSYAQQKRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLTRTQHYTPGHHMAPHPALTLLLPCLGSDIRARLLFVMESLLLSSALTLCARCLSISSFPPASLCPTPDRFLPHLKPDHAFVEIPSLPCLCFASLHQATLLHRYSPQYWTRLPTAPCEPIVTQVRH

SEQ ID NO: 850226 - protein, 220 aa, Homo sapiens
DGLSTGACQALAEVHAPLGGPRPRLCALAAEGHFLGHSWTGSRAGAHTGAPAWPSRRLRDLPAGGMWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFGLYHEH

SEQ ID NO: 850227 - protein, 959 aa, Homo sapiens
DGLSTGACQALAEVHAPLGGPRPRLCALAAEGHFLGHSWTGSRAGAHTGAPAWPSRRLRDLPAGGMWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFEKIRKALPSSEDLVKLAPDFDKIVESLSLLKDFFTSGSPEETAFRATDRGSESDKHFRKGLLGELILLQQQIQEHEEEARRAAGQYSTSYAQQKRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLVINTAEKQESASLIFVSCSKCYYMC

SEQ ID NO: 850228 - protein, 868 aa, Homo sapiens
DGLSTGACQALAEVHAPLGGPRPRLCALAAEGHFLGHSWTGSRAGAHTGAPAWPSRRLRDLPAGGMWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFEKIRKALPSSEDLVKLAPDFDKIVESLSLLKDFFTSGSPEETAFRATDRGSESDKHFRKGLLGELILLQQQIQEHEEEARRAAGQYSTSYAQQKRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDRILYNERS

SEQ ID NO: 850229 - protein, 612 aa, Homo sapiens
DGLSTGACQALAEVHAPLGGPRPRLCALAAEGHFLGHSWTGSRAGAHTGAPAWPSRRLRDLPAGGMWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFEKIRKALPSSEDLVKLAPDFDKIVESLSLLKDFFTSGSPEETAFRATDRGSESDKHFRKGLLGELILLQQQIQEHEEEARRAAGQYSTSYAQQKRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKDIGVL

SEQ ID NO: 850230 - protein, 1062 aa, Homo sapiens; identical to SEQ ID NO: 850220

SEQ ID NO: 850231 - protein, 280 aa, Homo sapiens
GVPQTGRAIGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKVREIQEKLDAFIEALHQEK

SEQ ID NO: 850232 - protein, 1062 aa, Homo sapiens; identical to SEQ ID NO: 850220

SEQ ID NO: 850233 - protein, 213 aa, Homo sapiens
MEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKVREIQEKLDAFIEALHQEK

SEQ ID NO: 850234 - protein, 1062 aa, Homo sapiens; identical to SEQ ID NO: 850220

SEQ ID NO: 850235 - protein, 205 aa, Homo sapiens
DGLSTGACQALAEVHAPLGGPRPRLCALAAEGHFLGHSWTGSRAGAHTGAPAWPSRRLRDLPAGGMWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIV

SEQ ID NO: 850236 - protein, 113 aa, Homo sapiens
MDTNLLSNIQKLFSERIDVFSPVEFNKVSVLTGIIKISLKTLLECVRLRTFGRFGLQQVQVDCHFLQLYLWRFVADEELVHLLLDEVVASAALRCPDPVPMEPSVVEVICERG

SEQ ID NO: 850237 - protein, 812 aa, Homo sapiens
QAGYGPRSIGSASSPSPSFPASRPWAAVGTMAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATDTIRKMKNDFRKMEDEMDRLATNMAVITDFSARISATLQDRHERITKLAGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEKELRNLEAELGPSPPAPDVLEFTDHGGSGFVGGLCQVAAAYQELFAAQGPAGAEKLAAFARQLGSRYFALVERRLAQEQGGGDNSLLVRALDRFHRRLRAPGALLAAAGLADAATEIVERVARERLGHHLQGLRAAFLGCLTDVRQALAAPRVAGKEGPGLAELLANVASSILSHIKASLAAVHLFTAKEVSFSNKPYFRGEFCSQGVREGLIVGFVHSMCQTAQSFCDSPGEKGGATPPALLLLLSRLCLDYETATISYILTLTDEQFLVQDQFPVTPVSTLCAEARETARRLLTHYVKVQGLVISQMLRKSVETRDWLSTLEPRNVRAVMKRVVEDTTAIDVQVGLLYEEGVRKAQSSDSSKRTFSVYSSSRQQGRYAPSYTPSAPMDTNLLSNIQKLFSERIDVFSPVEFNKVSVLTGIIKISLKTLLECVRLRTFGRFGLQQVQVDCHFLQLYLWRFVADEELVHLLLDEVVASAALRCPDPVPMEPSVVEVICERG

SEQ ID NO: 850238 - protein, 812 aa, Homo sapiens
RFNNNFMAPGSASSPSPSFPASRPWAAVGTMAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATDTIRKMKNDFRKMEDEMDRLATNMAVITDFSARISATLQDRHERITKLAGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEKELRNLEAELGPSPPAPDVLEFTDHGGSGFVGGLCQVAAAYQELFAAQGPAGAEKLAAFARQLGSRYFALVERRLAQEQGGGDNSLLVRALDRFHRRLRAPGALLAAAGLADAATEIVERVARERLGHHLQGLRAAFLGCLTDVRQALAAPRVAGKEGPGLAELLANVASSILSHIKASLAAVHLFTAKEVSFSNKPYFRGEFCSQGVREGLIVGFVHSMCQTAQSFCDSPGEKGGATPPALLLLLSRLCLDYETATISYILTLTDEQFLVQDQFPVTPVSTLCAEARETARRLLTHYVKVQGLVISQMLRKSVETRDWLSTLEPRNVRAVMKRVVEDTTAIDVQVGLLYEEGVRKAQSSDSSKRTFSVYSSSRQQGRYAPSYTPSAPMDTNLLSNIQKLFSERIDVFSPVEFNKVSVLTGIIKISLKTLLECVRLRTFGRFGLQQVQVDCHFLQLYLWRFVADEELVHLLLDEVVASAALRCPDPVPMEPSVVEVICERG

SEQ ID NO: 850239 - protein, 812 aa, Homo sapiens; identical to SEQ ID NO: 850238

SEQ ID NO: 850240 - protein, 796 aa, Homo sapiens
LVANSARGSFPVGTMAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATDTIRKMKNDFRKMEDEMDRLATNMAVITDFSARISATLQDRHERITKLAGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEKELRNLEAELGPSPPAPDVLEFTDHGGSGFVGGLCQVAAAYQELFAAQGPAGAEKLAAFARQLGSRYFALVERRLAQEQGGGDNSLLVRALDRFHRRLRAPGALLAAAGLADAATEIVERVARERLGHHLQGLRAAFLGCLTDVRQALAAPRVAGKEGPGLAELLANVASSILSHIKASLAAVHLFTAKEVSFSNKPYFRGEFCSQGVREGLIVGFVHSMCQTAQSFCDSPGEKGGATPPALLLLLSRLCLDYETATISYILTLTDEQFLVQDQFPVTPVSTLCAEARETARRLLTHYVKVQGLVISQMLRKSVETRDWLSTLEPRNVRAVMKRVVEDTTAIDVQVGLLYEEGVRKAQSSDSSKRTFSVYSSSRQQGRYAPSYTPSAPMDTNLLSNIQKLFSERIDVFSPVEFNKVSVLTGIIKISLKTLLECVRLRTFGRFGLQQVQVDCHFLQLYLWRFVADEELVHLLLDEVVASAALRCPDPVPMEPSVVEVICERG

SEQ ID NO: 850241 - protein, 731 aa, Homo sapiens
RFNNNFMAPGSASSPSPSFPASRPWAAVGTMAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATDTIRKMKNDFRKMEDEMDRLATNMAVITDFSARISATLQDRHERITKLAGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEKELRNLEAELGPSPPAPDVLEFTDHGGSGFVGGLCQVAAAYQELFAAQGPAGAEKLAAFARQLGSRYFALVERRLAQEQGGGDNSLLVRALDRFHRRLRAPGALLAAAGLADAATEIVERVARERLGHHLQGLRAAFLGCLTDVRQALAAPRVAGKEGPGLAELLANVASSILSHIKASLAAVHLFTAKEVSFSNKPYFRGEFCSQGVREGLIVGFVHSMCQTAQSFCDSPGEKGGATPPALLLLLSRLCLDYETATISYILTLTDEQFLVQDQFPVTPVSTLCAEARETARRLLTHYVKVQGLVISQMLRKSVETRDWLSTLEPRNVRAVMKRVVEDTTAIDVQVGLLYEEGVRKAQSSDSSKRTFSVYSSSRQQGRYAPSYTPSAPMDTNLLSNIQKLFSERIDVFSPVEFNKVRLPT

SEQ ID NO: 850242 - protein, 696 aa, Homo sapiens [sequence omitted]

SEQ ID NO: 850243 - protein, 874 aa, Homo sapiens
QAGYGPRSIGSASSPSPSFPASRPWAAVGTMAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATGSALDTQMRLGASGPCLGCLWSDGAVEAQWWQLAKHLRPASDLDYILRAGSPGTRVRGLRGVYTIRKMKNDFRKMEDEMDRLATNMAVITDFSARISATLQDRHERITKLAGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEKELRNLEAELGPSPPAPDVLEFTDHGGSGFVGGLCQVAAAYQELFAAQGPAGAEKLAAFARQLGSRYFALVERRLAQEQGGGDNSLLVRALDRFHRRLRAPGALLAAAGLADAATEIVERVARERLGHHLQGLRAAFLGCLTDVRQALAAPRVAGKEGPGLAELLANVASSILSHIKASLAAVHLFTAKEVSFSNKPYFRGEFCSQGVREGLIVGFVHSMCQTAQSFCDSPGEKGGATPPALLLLLSRLCLDYETATISYILTLTDEQFLVQDQFPVTPVSTLCAEARETARRLLTHYVKVQGLVISQMLRKSVETRDWLSTLEPRNVRAVMKRVVEDTTAIDVQVGLLYEEGVRKAQSSDSSKRTFSVYSSSRQQGRYAPSYTPSAPMDTNLLSNIQKLFSERIDVFSPVEFNKVSVLTGIIKISLKTLLECVRLRTFGRFGLQQVQVDCHFLQLYLWRFVADEELVHLLLDEVVASAALRCPDPVPMEPSVVEVICERG

SEQ ID NO: 850244 - protein, 835 aa, Homo sapiens
MPLYSKLGDREKKKRKEKASRPWAAVGTMAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATDTIRKMKNDFRKMEDEMDRLATNMAVITDFSARISATLQDRHERITKLAGGRCRAGPAVGLSWGSGANVTLRPPGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEKELRNLEAELGPSPPAPDVLEFTDHGGSGFVGGLCQVAAAYQELFAAQGPAGAEKLAAFARQLGSRYFALVERRLAQEQGGGDNSLLVRALDRFHRRLRAPGALLAAAGLADAATEIVERVARERLGHHLQGLRAAFLGCLTDVRQALAAPRVAGKEGPGLAELLANVASSILSHIKASLAAVHLFTAKEVSFSNKPYFRGEFCSQGVREGLIVGFVHSMCQTAQSFCDSPGEKGGATPPALLLLLSRLCLDYETATISYILTLTDEQFLVQDQFPVTPVSTLCAEARETARRLLTHYVKVQGLVISQMLRKSVETRDWLSTLEPRNVRAVMKRVVEDTTAIDVQVGLLYEEGVRKAQSSDSSKRTFSVYSSSRQQGRYAPSYTPSAPMDTNLLSNIQKLFSERIDVFSPVEFNKVSVLTGIIKISLKTLLECVRLRTFGRFGLQQVQVDCHFLQLYLWRFVADEELVHLLLDEVVASAALRCPDPVPMEPSVVEVICERG

SEQ ID NO: 850245 - protein, 282 aa, Homo sapiens
MCQTAQSFCDSPGEKGGATPPALLLLLSRLCLDYETATISYILTLTDEQFLVQDQFPVTPVSTLCAEARETARRLLTHYVKVQGLVISQMLRKSVETRDWLSTLEPRNVRAVMKRVVEDTTAIDVQVGLLYEEGVRKAQSSDSSKRTFSVYSSSRQQGRYAPSYTPSAPMDTNLLSNIQKLFSERIDVFSPVEFNKVSVLTGIIKISLKTLLECVRLRTFGRFGLQQVQVDCHFLQLYLWRFVADEELVHLLLDEVVASAALRCPDPVPMEPSVVEVICERG

SEQ ID NO: 850246 - protein, 269 aa, Homo sapiens
MSSALSISVLLLLLSRLCLDYETATISYILTLTDEQFLVQDQFPVTPVSTLCAEARETARRLLTHYVKVQGLVISQMLRKSVETRDWLSTLEPRNVRAVMKRVVEDTTAIDVQVGLLYEEGVRKAQSSDSSKRTFSVYSSSRQQGRYAPSYTPSAPMDTNLLSNIQKLFSERIDVFSPVEFNKVSVLTGIIKISLKTLLECVRLRTFGRFGLQQVQVDCHFLQLYLWRFVADEELVHLLLDEVVASAALRCPDPVPMEPSVVEVICERG

SEQ ID NO: 850247 - protein, 113 aa, Homo sapiens; identical to SEQ ID NO: 850236

SEQ ID NO: 850248 - protein, 113 aa, Homo sapiens; identical to SEQ ID NO: 850236

SEQ ID NO: 850249 - protein, 318 aa, Homo sapiens
QAGYGPRSIGSASSPSPSFPASRPWAAVGTMAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATDTIRKMKNDFRKMEDEMDRLATNMAVITDFSARISATLQDRHERITKLAGVHALLRKLQFLFELPSRRRLRSAVGDGARGPRKNFVSFTHLVPFLLGTVYGLEKIQLVLADDAEVNVASGAQVVEDASCDGFAHQILGFLLLRNRTAAIMSPAKLGLLRDIQQCTSTNS

SEQ ID NO: 850250 - protein, 209 aa, Homo sapiens
QAGYGPRSIGSASSPSPSFPASRPWAAVGTMAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATDTNPGHESQTENRNFFPRGTRQWAQGATLQATWGTRGALGALIPKSICGQRLQFQPRNVS

SEQ ID NO: 850251 - protein, 78 aa, Homo sapiens
MYCLIQAVRWTRRCAWEPAVPALAACGLMEQLRHSGGSWLSTCGLLRIWTNSEGRLSWAPGLGGYGEYVSNACFGNIN

SEQ ID NO: 850252 - protein, 242 aa, Homo sapiens
PRVADAWVQFLVQDQFPVTPVSTLCAEARETARRLLTHYVKVQGLVISQMLRKSVETRDWLSTLEPRNVRAVMKRVVEDTTAIDVQVGLLYEEGVRKAQSSDSSKRTFSVYSSSRQQGRYAPSYTPSAPMDTNLLSNIQKLFSERIDVFSPVEFNKVSVLTGIIKISLKTLLECVRLRTFGRFGLQQVQVDCHFLQLYLWRFVADEELVHLLLDEVVASAALRCPDPVPMEPSVVEVICERG

SEQ ID NO: 850253 - protein, 812 aa, Homo sapiens; identical to SEQ ID NO: 850238

SEQ ID NO: 850254 - protein, 803 aa, Homo sapiens
LVANSARGSFPASRPWAAVGTMAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATDTIRKMKNDFRKMEDEMDRLATNMAVITDFSARISATLQDRHERITKLAGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEKELRNLEAELGPSPPAPDVLEFTDHGGSGFVGGLCQVAAAYQELFAAQGPAGAEKLAAFARQLGSRYFALVERRLAQEQGGGDNSLLVRALDRFHRRLRAPGALLAAAGLADAATEIVERVARERLGHHLQGLRAAFLGCLTDVRQALAAPRVAGKEGPGLAELLANVASSILSHIKASLAAVHLFTAKEVSFSNKPYFRGEFCSQGVREGLIVGFVHSMCQTAQSFCDSPGEKGGATPPALLLLLSRLCLDYETATISYILTLTDEQFLVQDQFPVTPVSTLCAEARETARRLLTHYVKVQGLVISQMLRKSVETRDWLSTLEPRNVRAVMKRVVEDTTAIDVQVGLLYEEGVRKAQSSDSSKRTFSVYSSSRQQGRYAPSYTPSAPMDTNLLSNIQKLFSERIDVFSPVEFNKVSVLTGIIKISLKTLLECVRLRTFGRFGLQQVQVDCHFLQLYLWRFVADEELVHLLLDEVVASAALRCPDPVPMEPSVVEVICERG

SEQ ID NO: 850255 - protein, 810 aa, Homo sapiens [sequence omitted]

SEQ ID NO: 850256 - protein, 731 aa, Homo sapiens; identical to SEQ ID NO: 850241

SEQ ID NO: 850257 - protein, 861 aa, Homo sapiens
LVANSARGSFPASRPWAAVGTMAAAAAAGPSPGSGPGDSPEGPEGEAPERRRKAHGMLKLYYGLSEGEAAGRPAGPDPLDPTDLNGAHFDPEVYLDKVCAHGEWGGAGRGEGNQAPAILLPQIMPPTFCEVQEEQVFIRGRTSAREYEQLRRLRGLRRECPLAQLMDSETDMVRQIRALDSDMQTLVYENYNKFISATDTIRKMKNDFRKMEDEMDRLATNMAVITDFSARISATLQDRHERITKLAGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEKELRNLEAELGPSPPAPDVLEFTDHGGSGFVGGLCQVAAAYQELFAAQGPAGAEKLAAFARQLGSRYFALVERRLAQEQGGGDNSLLVRALDRFHRRLRAPGALLAAAGLADAATEIVERVARERLGHHLQGLRAAFLGCLTDVRQALAAPRVAGKEGPGLAELLANVASSILSHIKASLAAVHLFTAKEVSFSNKPYFRGEFCSQGVREGLIVGFVHSMCQTAQSFCDSPGEKGGATPPALLLLLSRLCLDYETATISYILTLTDEQFLVQDQFPVTPVSTLCAEARETARRLLTHYVKVQGLVISQMLRKSVETRDWLSTLEPRNVRAVMKRVVEDTTAIDVQVGLLYEEGVRKAQSSDSSKRTFSVYSSSRQQGRYAPSYTPSAPMDTNLLSNIQKLFSERIDVFSPVEFNKVSVLTGIIKISLKTLLECVRLRTFGRFGLQQVQVDCHFLQLYLWRFVADEELVHLLLDEVVASAALRCPDPVPMEPSVVEVICERG

SEQ ID NO: 850258 - protein, 690 aa, Homo sapiens
PPPPTLRLVRAWFNRPRENYNKFISATDTIRKMKNDFRKMEDEMDRLATNMAVITDFSARISATLQDRHERITKLAGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEKELRNLEAELGPSPPAPDVLEFTDHGGSGFVGGLCQVAAAYQELFAAQGPAGAEKLAAFARQLGSRYFALVERRLAQEQGGGDNSLLVRALDRFHRRLRAPGALLAAAGLADAATEIVERVARERLGHHLQGLRAAFLGCLTDVRQALAAPRVAGKEGPGLAELLANVASSILSHIKASLAAVHLFTAKEVSFSNKPYFRGEFCSQGVREGLIVGFVHSMCQTAQSFCDSPGEKGGATPPALLLLLSRLCLDYETATISYILTLTDEQFLVQDQFPVTPVSTLCAEARETARRLLTHYVKVQGLVISQMLRKSVETRDWLSTLEPRNVRAVMKRVVEDTTAIDVQVGLLYEEGVRKAQSSDSSKRTFSVYSSSRQQGRYAPSYTPSAPMDTNLLSNIQKLFSERIDVFSPVEFNKVSVLTGIIKISLKTLLECVRLRTFGRFGLQQVQVDCHFLQLYLWRFVADEELVHLLLDEVVASAALRCPDPVPMEPSVVEVICERG

SEQ ID NO: 850259 - protein, 656 aa, Homo sapiens
RFNNNFMAPGSASSPSPSFPASRPWAAVGTMAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATDTIRKMKNDFRKMEDEMDRLATNMAVITDFSARISATLQDRHERITKLAGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEKELRNLEAELGPSPPAPDVLEFTDHGGSGFVGGLCQVAAAYQELFAAQGPAGAEKLAAFARQLGSRYFALVERRLAQEQGGGDNSLLVRALDRFHRRLRAPGALLAAAGLADAATEIVERVARERLGHHLQGLRAAFLGCLTDVRQALAAPPAPDVSEYTTMDAVRYAGRPLPGGGGLPGAARGPPAQHAAEKLRETYARQPDKDRITLAAACNKTNKKPTYRKPGHIETKQPQQTQRKLEKPKLGAKSREDRRNPTGNPEDTPRDTPTNRQTHTENPARSQNAQTQRHNTTATAPKIRKRENGNPTPPQRGPQIPRHKDTPQRTPPDHTTPQRTKKRPTEHTAR

SEQ ID NO: 850260 - protein, 381 aa, Homo sapiens
RFNNNFMAPGSASSPSPSFPASRPWAAVGTMAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATDTIRKMKNDFRKMEDEMDRLATNMAVITDFSARISATLQDRHERITKLAGVHALLRKLQFLFELPSRLTKCVELGAYGQAVRYQGRAQAVLQQYQHLPSFRAIQDDCQVITARLAQQLRQRFREGGQAPGAGNAWSCVAWGPWRAARSLDTPAVEQPETRGTWGQTGTKVRLRPESSGKETTNERDTDAVTAQKSKEGTEKTTQKRATENLAGDHDKNEEATRDDAAQRARE

SEQ ID NO: 850261 - protein, 121 aa, Homo sapiens
TASVQGKEAVLLDQRTSYVSEKSRRWIWDQKNWILAPVSPSLLGELEPALPSLCLRALLCTLGMVEHAIPRALWSVHSRQQTGAVVTAIITVIALVLTADHDVKSLSTQLRNSYCDLQCGV

SEQ ID NO: 850262 - protein, 306 aa, Homo sapiens
GRGLGSAHSQPRSHPAPRRSTRANPVTHLRRANSSLALPLTHAHTRLEMAAAAAAAGDSDSWDADAFSVEDPVRKVGGGGTAGGDRWEGEDEDEDVKDNWDDDDDEKKEEAEVKPEVKISEKKKIAEKIKEKERQQKKRQEEIKKRLEEPEEPKVLTPEEQLADKLRLKKLQEESDLELAKETFGVNNAVYGIDAMNPSSRDDFTEFGKLLKDKITQYEKSLYYASFLEVLVRDVCISLEIDDLKKITNSLTVLCSEKQKQEKQSKAKKKKKGVVPGGGLKATMKDDLADYGGYDGGYVQDYEDFM

SEQ ID NO: 850263 - protein, 221 aa, Homo sapiens
MQELLMEVLFFEDNWDDDDDEKKEEAEVKPEVKISEKKKIAEKIKEKERQQKKRQEEIKKRLEEPEEPKVLTPEEQLADKLRLKKLQEESDLELAKETFGVNNAVYGIDAMNPSSRDDFTEFGKLLKDKITQYEKSLYYASFLEVLVRDVCISLEIDDLKKITNSLTVLCSEKQKQEKQSKAKKKKKGVVPGGGLKATMKDDLADYGGYDGGYVQDYEDFM

SEQ ID NO: 850264 - protein, 250 aa, Homo sapiens
GGREREGDIGYVRGWVVIRPRLRRANSSLALPLTHAHTRLEMAAAAAAAGDSDSWDADAFSVEDPVRKVGGGGTAGGDRWEGEDEDEDVKLEEPEEPKVLTPEEQLADKLRLKKLQEESDLELAKETFGVNNAVYGIDAMNPSSRDDFTEFGKLLKDKITQYEKSLYYASFLEVLVRDVCISLEIDDLKKITNSLTVLCSEKQKQEKQSKAKKKKKGVVPGGGLKATMKDDLADYGGYDGGYVQDYEDFM

SEQ ID NO: 850265 - protein, 177 aa, Homo sapiens
MGVRAGRTQGKKKLKKRLEEPEEPKVLTPEEQLADKLRLKKLQEESDLELAKETFGVNNAVYGIDAMNPSSRDDFTEFGKLLKDKITQYEKSLYYASFLEVLVRDVCISLEIDDLKKITNSLTVLCSEKQKQEKQSKAKKKKKGVVPGGGLKATMKDDLADYGGYDGGYVQDYEDFM

SEQ ID NO: 850266 - protein, 306 aa, Homo sapiens; identical to SEQ ID NO: 850262

SEQ ID NO: 850267 - protein, 306 aa, Homo sapiens; identical to SEQ ID NO: 850262

SEQ ID NO: 850268 - protein, 306 aa, Homo sapiens; identical to SEQ ID NO: 850262

SEQ ID NO: 850269 - protein, 306 aa, Homo sapiens; identical to SEQ ID NO: 850262

SEQ ID NO: 850270 - protein, 232 aa, Homo sapiens
GRGLGSAHSQPRSHPAPRRSTRANPVTHLRRANSSLALPLTHAHTRLEMAAAAAAAGDSDSWDADAFSVEDPVRKVGGGGTAGGDRWEGEDEDEDVKDNWDDDDDEKKEEAEVKPEVKISEKKKIAEKIKEKERQQKKRQEEIKKRLEEPEEPKVLTPEEQLADKLRLKKLQEESDLELAKETFGVNNAVYGIDAMNPSSRDDFTEFGKLLKDKITQYEKSLYYASFFWEGL

SEQ ID NO: 850271 - protein, 299 aa, Homo sapiens
GGREREGDIGYVRGWVVIRPRLRRANSSLALPLTHAHTRLEMAAAAAAAGDSDSWDADAFSVEDPVRKVGGGGTAGGDRWEGEDEDEDVKDNWDDDDDEKKEEAEVKPEVKISEKKKIAEKIKEKERQQKKRQEEIKKRLEEPEEPKVLTPEEQLADKLRLKKLQEESDLELAKETFGVNNAVYGIDAMNPSSRDDFTEFGKLLKDKITQYEKSLYYASFLEVLVRDVCISLEIDDLKKITNSLTVLCSEKQKQEKQSKAKKKKKGVVPGGGLKATMKDDLADYGGYDGGYVQDYEDFM

SEQ ID NO: 850272 - protein, 306 aa, Homo sapiens; identical to SEQ ID NO: 850262

SEQ ID NO: 850273 - protein, 75 aa, Homo sapiens
GGREREGDIGYVRGWVVIRPRVLCSDKQKQKKQSKAKKKKKGVVPGGGLKATMKDDLADYGGYDGGYVQDYEDFM

SEQ ID NO: 850274 - protein, 306 aa, Homo sapiens; identical to SEQ ID NO: 850262

SEQ ID NO: 850275 - protein, 240 aa, Homo sapiens
GRGLGSAHSQPRSHPAPRRSTRANPVTHLRRANSSLALPLTHAHTRLEMAAAAAAAGDSDSWDADAFSVEDPVRKVGGGGTAGGDRWEGEDEDEDVKDNWDDDDDEKKEEAEVKPEVKISEKKKIAEKIKEKERQQKKRQEEIKKRLEEPEEPKVLTPEEQLADKLRLKKLQEESDLELAKETFGVNNAVYGIDAMNPSSRDDFTEFGKLLKDKITQYEKSLYYASFLEVLVRDVCISCK

SEQ ID NO: 850276 - protein, 239 aa, Homo sapiens
GRGLGSAHSQPRSHPAPRRSTRANPVTHLRRANSSLALPLTHAHTRLEMAAAAAAAGDSDSWDADAFSVEDPVRKVGGGGTAGGDRWEGEDEDEDVKDNWDDDDDEKKEEAEVKPEVKISEKKKIAEKIKEKERQQKKRQEEIKKRLEEPEEPKVLTPEEQLADKLRLKKLQEESDLELAKETFGVNNAVYGIVYAVQHKLFNVCPSLPVAHLVKLDNGSLESYLSVSKLMFSFRFISQ

SEQ ID NO: 850277 - protein, 1142 aa, Homo sapiens
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKVEQLKEELSSKEAQWEELKKKAAGLQAEIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQDEEEGIMGIANQRLSSAILFRTIIQPLLELDQNRSKLKLYIGHLTTLCHDRDPLILRGLTPPASYNLDDDQAAWENELQKMTRGQLQDELEKGERDNAELQEFANAILQQIADHCPDILEQVVNALEESS

SEQ ID NO: 850278 - protein, 960 aa, Homo sapiens
MNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKVEQLKEELSSKEAQWEELKKKAAGLQAEIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQDEEEEYMGIANQRLSSAILFRTIIQPLLELDQNRSKLKLYIGHLTTLCHDRDPLILRGLTPPASYNLDDDQAAWENELQKMTRGQLQDELEKGERDNAELQEFANAILQQIADHCPDILEQVVNALEESS

SEQ ID NO: 850279 - protein, 595 aa, Homo sapiens
MAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQDEEEEYMGIANQRLSSAILFRTIIQPLLELDQNRSKLKLYIGHLTTLCHDRDPLILRGLTPPASYNLDDDQAAWENELQKMTRGQLQDELEKGERDNAELQEFANAILQQIADHCPDILEQVVNALEESS

SEQ ID NO: 850280 - protein, 793 aa, Homo sapiens
QESTESLSASFLQEMHRRFENAPDSAKTKALQTVIEMKDSKISSMERGLRDLEEEIQMLKSNGALSTEEREEEMKQMEVYRSHSKFMKNKVEQLKEELSSKEAQWEELKKKAAGLQAEIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQDEEEEYMGIANQRLSSAILFRTIIQPLLELDQNRSKLKLYIGHLTTLCHDRDPLILRGLTPPASYNLDDDQAAWENELQKMTRGQLQDELEKGERDNAELQEFANAILQQIADHCPDILEQVVNALEESS

SEQ ID NO: 850281 - protein, 1082 aa, Homo sapiens
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKVEQLKEELSSKEAQWEELKKKAAGLQAEIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQIIQPLLELDQNRSKLKLYIGHLTTLCHDRDPLILRGLTPPASYNLDDDQAAWENELQKMTRGQVSLSLKL

SEQ ID NO: 850282 - protein, 513 aa, Homo sapiens
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKVEQLKEELSSKEAQWEELKKKAAGLQAEIGQVKQELSRKDTELLALQTKLETLTNQFSDSKQHIEVLKESLMSH

SEQ ID NO: 850283 - protein, 540 aa, Homo sapiens
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKVEQLKEELSSKEAQWEELKKKAAGLQAEIGQVKQELSRKDTELLALQTKLETLTNQFSDSKQHIEVLKESLTAKEQRAAILQTEVETILGFVGSWFLGTFS

SEQ ID NO: 850284 - protein, 1070 aa, Homo sapiens
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQDEEEEYMGIANQRLSSAILFRTIIQPLLELDQNRSKLKLYIGHLTTLCHDRDPLILRGLTPPASYNLDDDQAAWENELQKMTRGQLQDELEKGERDNAELQEFANAILQQIADHCPDILEQVVNALEESS

SEQ ID NO: 850285 - protein, 916 aa, Homo sapiens
MTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKVEQLKEELSSKEAQWEELKKKAAGLQAEIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQDEEEGIMGIANQRLSSAILFRTIIQPLLELDQNRSKLKLYIGHLTTLCHDRDPLILRGLTPPASYNLDDDQAAWENELQKMTRGQLQDELEKGERDNAELQEFANAILQQIADHCPDILEQVVNALEESS

SEQ ID NO: 850286 - protein, 1120 aa, Homo sapiens
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKVEQLKEELSSKEAQWEELKKKAAGLQAEIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQIIQPLLELDQNRSKLKLYIGHLTTLCHDRDPLILRGLTPPASYNLDDDQAAWENELQKMTRGQLQDELEKGERDNAELQEFANAILQQIADHCPDILEQVVNALEESS

SEQ ID NO: 850287 - protein, 513 aa, Homo sapiens
EHGMVVQAMSGILRKEGLHVRLEMTRKNVDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQIIQPLLELDQNRSKLKLYIGHLTTLCHDRDPLILRGLTPPASYNLDDDQAAWENELQKMTRGQLQDELEKGERDNAELQEFANAILQQIADHCPDILEQVVNALEESS

SEQ ID NO: 850288 - protein, 979 aa, Homo sapiens
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKVEQLKEELSSKEAQWEELKKKAAGLQAEIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQ

SEQ ID NO: 850289 - protein, 439 aa, Homo sapiens
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRNGHIGDSSG

SEQ ID NO: 850290 - protein, 686 aa, Homo sapiens [sequence omitted]

SEQ ID NO: 850291 - protein, 529 aa, Homo sapiens [sequence omitted]

SEQ ID NO: 850292 - protein, 510 aa, Homo sapiens
MNAEEDSEEMPSLLTSTVQVASDNLIPQIRDKEDPQEMPHSPLGSMPEIRDNSPEPNDPEEPQEVSSTPSDKKGKKRKRCIWSTPKRRHKKKSLPRGTASSRHGIQKKLKRVDQVPQKKDDSTCNSTVETRAQKARTECARKSRSEEIIDGTSEMNEGKRSQKTPSTPRRVTQGAASPGHGIQEKLQVVDKVTQRKDDSTWNSEVMMRVQKARTKCARKSRSKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKRKNSDECEVCCQGGQLLCCGTCPRVFHEDCHIPPVEAKRMLWSCTFCRMKRSSGSQQCHHVSKTLERQMQPQDQLKCEFLLLKAYCHPQSSFFTGIPFNIRDYGEPFQEAMWLDLVKERLITEMYTVAWFVRDMRLMFRNHKTFYKASDFGQVGLDLEAEFEKDLKDVLGFHEANDGGFWTLP

SEQ ID NO: 850293 - protein, 165 aa, Homo sapiens
RYLPLQRKNSDECEVCCQGGQLLCCGTCPRVFHEDCHIPPVEAKRMLWSCTFCRMKRSSGSQQCHHVSKTLERQMQPQDQLIRDYGEPFQEAMWLDLVKERLITEMYTVAWFVRDMRLMFRNHKTFYKASDFGQVGLDLEAEFEKDLKDVLGFHEANDGGFWTLP

SEQ ID NO: 850294 - protein, 546 aa, Homo sapiens [sequence omitted]

SEQ ID NO: 850295 - protein, 710 aa, Homo sapiens [sequence omitted]

SEQ ID NO: 850296 - protein, 496 aa, Homo sapiens
MTRAMEEALFQHFMHQKLGIAYAIHKPFPFFEGLLDNSIITKRMYMESLEACRNLIPVSRVVHNILTQLERTFNLSLLVTLFSQINLREYPNLVTIYRSFKRVGASYERQSRDTPILLEAPTGLAEGSSLHTPLALPPPQPPQPSCSPCAPRVSEPGTSSQQSDEILSESPSPSDPVLPLPALIQEGRSTSVTNDKLTSKMNAEEDSEEMPSLLTSTVQVASDNLIPQIRDKEDPQEMPHSPLGSMPEIRDNSPEPNDPEEPQEVSSTPSDKKGKKRKRCIWSTPKRRHKKKSLPREIIDGTSEMNEGKRSQKTPSTPRRVTQGAASPGHGIQEKLQVVDKVTQRKDDSTWNSEVMMRVQKARTKCARKSRSKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKSGLLLCPPRINLKRELNSK

SEQ ID NO: 850297 - protein, 396 aa, Homo sapiens [sequence omitted]

SEQ ID NO: 850298 - protein, 546 aa, Homo sapiens [sequence omitted]

SEQ ID NO: 850299 - protein, 346 aa, Homo sapiens [sequence omitted]

SEQ ID NO: 850300 - protein, 248 aa, Homo sapiens
MASSGVKNTPRWRRKAPHGRERKEKGKKRKRCIWSTPKRRHKKKSLPREIIDGTSEMNEGKRSQKTPSTPRRVTQGAASPGHGIQEKLQVVDKVTQRKDDSTWNSEVMMRVQKARTKCARKSRSKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKSGLLLCPPRINLKRELNSK

SEQ ID NO: 850301 - protein, 68 aa, Homo sapiens
TASSRHGIQKKLKRVDQVPQKKDDSTCNSTVETRAQKARTECARKSRSEGKADDGICHLNGSVWEGLS

SEQ ID NO: 850302 - protein, 390 aa, Homo sapiens
MVTRAGAGTAVAGAVVVALLSAALALYGPPLDAVLERAFSLRKAHSIKDMENTLQLVRNIIPPLSSTKHKGQDGRIGVVGGCQEYTGAPYFAAISALKVGADLSHVFCASAAAPVIKAYSPELIVHPVLDSPNAVHEVEKWLPRLHALVVGPGLGRDDALLRNVQGILEVSKARDIPVVIDADGLWLVAQQPALIHGYRKAVLTPNHVEFSRLYDAVLRGPMDSDDSHGSVLRLSQALGNVTVVQKGERDILSNGQQVLVCSQEGSSRRCGGQGDLLSGSLGVLVHWALLAGPQKTNGGISDLKLTIWGPEIETGVKTRAQGSCGPRTTTPTSPHLLLSPSPQVQPSPGGRVWRLLSHQAVQPPSLPEARSLHHHLRHDRRGGGRLQQAL

SEQ ID NO: 850303 - protein, 108 aa, Homo sapiens
MCSPAELWGWTRYQNQGRTLRRLWAGVCTSTLVHSHSHAHMCTRMQFIHMHSCAHSLARPCTLALIHMHGHAHSLAHALAHSSTHSCAQGTQSRCSQRDSDTFEMRVF

SEQ ID NO: 850304 - protein, 225 aa, Homo sapiens
MIVHPVLDSPNAVHEVEKWLPRLHALVVGPGLGRDDALLRNVQGILEVSKARDIPVVIDADGLWLVAQQPALIHGYRKAVLTPNHVEFSRLYDAVLRGPMDSDDSHGSVLRLSQALGNVTVVQKGERDILSNGQQVLVCSQEGSSRRCGGQGDLLSGSLGVLVHWALLAGPQKTNGSSPLLVAAFGACSLTRQCNHQAFQKHGRSTTTSDMIAEVGAAFSKLFET

SEQ ID NO: 850305 - protein, 349 aa, Homo sapiens
FQWLVSGDGAGAAGNPECCPMALGPRCGAIRACRRVLERAFSLRKAHSIKDMENTLQLVRNIIPPLSSTKHKGQDGRIGVVGGCQEYTGAPYFAAISALKVGADLSHVFCASAAAPVIKAYSPELIVHPVLDSPNAVHEVEKWLPRLHALVVGPGLGRDDALLRNVQGILEVSKARDIPVVIDADGLWLVAQQPALIHGYRKAVLTPNHVEFSRLYDAVLRGPMDSDDSHGSVLRLSQALGNVTVVQKGERDILSNGQQVLVCSQEGSSRRCGGQGDLLSGSLGVLVHWALLAGPQKTNGSSPLLVAAFGACSLTRQCNHQAFQKHGRSTTTSDMIAEVGAAFSKLFET

SEQ ID NO: 850306 - protein, 295 aa, Homo sapiens
MAGFRRRRGGSWESGMLPDGPGSSLWGNPGLQTSDSPNAVHEVEKWLPRLHALVVGPGLGRDDALLRNVQGILEVSKARDIPVVIDADGLWLVAQQPALIHGYRKAVLTPNHVEFSRLYDAVLRGPMDSDDSHGSVLRLSQALGNVTVVQKGERDILSNGQQVLVCSQEGSSRRCGGQGDLLSGSLGVLVHWALLAGPQKTNGGISDLKLTIWGPEIETGVKTRAQGSCGPRTTTPTSPHLLLSPSPQVQPSPGGRVWRLLSHQAVQPPSLPEARSLHHHLRHDRRGGGRLQQAL

SEQ ID NO: 850307 - protein, 126 aa, Homo sapiens
MDSDDSHGSVLRLSQALGNVTVVQKGERDILSNGQQVLVCSQEGSSRRCGGQGDLLSGSLGVLVHWALLAGPQKTNGSSPLLVAAFGACSLTRQCNHQAFQKHGRSTTTSDMIAEVGAAFSKLFET

SEQ ID NO: 850308 - protein, 283 aa, Homo sapiens
FQWLVSGDGAGAAGNPECCPMALGPRCGAIRACRRVLERAFSLRKAHSIKDMENTLQLVRNIIPPLSSTKHKGQDGRIGVVGGCQEYTGAPYFAAISALKVGILEVSKARDIPVVIDADGLWLVAQQPALIHGYRKAVLTPNHVEFSRLYDAVLRGPMDSDDSHGSVLRLSQALGNVTVVQKGERDILSNGQQVLVCSQEGSSRRCGGQGDLLSGSLGVLVHWALLAGPQKTNGSSPLLVAAFGACSLTRQCNHQAFQKHGRSTTTSDMIAEVGAAFSKLFET

SEQ ID NO: 850309 - protein, 349 aa, Homo sapiens; identical to SEQ ID NO: 850305

SEQ ID NO: 850310 - protein, 121 aa, Homo sapiens
MALRRPGERQYRGHVCLGSSTAVSLGMFASSKDTGNCGFSQHSSWQCRPRVSFCCLCGWFSWSGLTLTCSLVPCLSGAWYGFVPDACIRVFSYTFSSIFPQQGPNPPGSLQSLFGLMMTLE

SEQ ID NO: 850311 - protein, 121 aa, Homo sapiens; identical to SEQ ID NO: 850310

SEQ ID NO: 850312 - protein, 121 aa, Homo sapiens; identical to SEQ ID NO: 850310

SEQ ID NO: 850313 - protein, 121 aa, Homo sapiens; identical to SEQ ID NO: 850310

SEQ ID NO: 850314 - protein, 310 aa, Homo sapiens
FQWLVSGDGAGAAGNPECCPMALGPRCGAIRACRRVLERAFSLRKAHSIKDMENTLQLVRNIIPPLSSTKHKGQDGRIGVVGGCQEYTGAPYFAAISALKVGADLSHVFCASAAAPVIKAYSPELIVHPVLDSPNAVHEVEKWLPRLHALVVGPGLGRDDALLRNVQGILEVSKARDIPVVIDADGLWLVAQQPALIHGYRKAVLTPNHVEFSRLYDAVLRGPMDSDDSHGSVLRLSQALGNVTVVQKGERDILSNGQQVLVCSQEGSSRRCGGQGDLLSGSLGVLVHWALLAGPQKTNGGKATSSFILL

SEQ ID NO: 850315 - protein, 101 aa, Homo sapiens
FQWLVSGDGAGAAGNPECCPMALGPRCGAIRACRRVLERAFSLRKAHSIKDMENTLQLVRNIIPPLSSTKHKGQDGRIGVVGGCQEYTGAPYFAAISALKV

SEQ ID NO: 850316 - protein, 126 aa, Homo sapiens; identical to SEQ ID NO: 850307

SEQ ID NO: 850317 - protein, 349 aa, Homo sapiens; identical to SEQ ID NO: 850305

SEQ ID NO: 850318 - protein, 414 aa, Homo sapiens
FQWLVSGDGAGAAGNPECCPMALGPRCGAIRACRRVLERAFSLRKAHSIKDMENTLQLVRNIIPPLSSTKHKGQDGRIGVVGGCQEYTGAPYFAAISALKVGADLSHVFCASAAAPVIKAYSPELIVHPVLDSPNAVHEVEKWLPRLHALVVGPGLGRDDALLRNVQGILEVSKARDIPVVIDADGLWLVAQQPALIHGYRKAVLTPNHVEFSRLYDAVLRGPMDSDDSHGSVLRLSQALGNVTVVQKGERDILSNGQQVLVCSQEGSSRRCGGQGDLLSGSLGVLVHWALLAGPQKTNGSSPLLVAAFGACSLTRQCNHQAFQKHGRSTTTSDMIAELLGSNWEDRNEENHMRMKNSLAAQQSFSACSQIGEVSTCYSLCRRPSFLLCFPSLVFPPAGSWAGVPGCLPESRLH

SEQ ID NO: 850319 - protein, 126 aa, Homo sapiens; identical to SEQ ID NO: 850307

SEQ ID NO: 850320 - protein, 126 aa, Homo sapiens; identical to SEQ ID NO: 850307

SEQ ID NO: 850321 - protein, 121 aa, Homo sapiens; identical to SEQ ID NO: 850310

SEQ ID NO: 850322 - protein, 111 aa, Homo sapiens
MDSDDSHGSVLRLSQALGNVTVVQKGERDILSNGQQVLVCSQEGSSRRCGGQGDLLSGSLGVLVHWALLAGPQKTNGRQCNHQAFQKHGRSTTTSDMIAEVGAAFSKLFET

SEQ ID NO: 850323 - protein, 121 aa, Homo sapiens; identical to SEQ ID NO: 850310

SEQ ID NO: 850324 - protein, 349 aa, Homo sapiens; identical to SEQ ID NO: 850305

SEQ ID NO: 850325 - protein, 186 aa, Homo sapiens
FQWLVSGDGAGAAGNPECCPMALGPRCGAIRACRRVLERAFSLRKAHSIKDMENTLQLVRNIIPPLSSTKHKGQDGRIGVVGGCQEYTGAPYFAAISALKVGADLSHVFCASAAAPVIKAYSPELIVHPVLDSPNAVHEVEKWLPRLHALVVGPGLGRDDALLRNVQGILEVSKARDIPVVIDAVS

SEQ ID NO: 850326 - protein, 149 aa, Homo sapiens
PSGLLGAGGEITVCVQGSELLSDDEVPLGIGGQFLKHQAEAQPEDLSLEEEARFSSQQPPAQLSHRPQRGPLLWPERGPPAPRHQEMASASPFLSAWSQVPVNLEDVAVYLSGEEPRCMDPAQRDAPLENEDLGIQFGGRPLIGKECPF

SEQ ID NO: 850327 - protein, 480 aa, Homo sapiens
MATVPGLQPLPTLEQDLEQEEILIVKVEEDFCLEEEPSVETEDPSPETFRQLFRLFCYQEVAGPREALSRLWELCCRWLRPELRTKEQILELLVLEQFLTVLPGEIQARVREQQPESGEEAVVLVEGLQRKPRKHRQRGSELLSDDEVPLGIGGQFLKHQAEAQPEDLSLEEEARFSSQQPPAQLSHRPQRGPLLWPERGPPAPRHQEMASASPFLSAWSQVPVNLEDVAVYLSGEEPRCMDPAQRDAPLENEGPGIQLEDGGDGREDAPLRMEWYRVLSARCQGPGHPLPGQRPAPVRGLVRPDQPRGGPPPGRRASHGADKPYTCPECGKGFSKTSHLTKHQRTHTGERPYKCLVCGKGFSDRSNFSTHQRVHTGEKPYPCPECGKRFSQSSSLVIHRRTHSGERPYACTQCGKRFNNSSHFSAHRRTHTGEKPYTCPACGRGFRRGTDLHKHQRTHMGAGSLPTLQPVAPGGPGAKA

SEQ ID NO: 850328 - protein, 480 aa, Homo sapiens; identical to SEQ ID NO: 850327

SEQ ID NO: 850329 - protein, 208 aa, Homo sapiens [sequence omitted]

SEQ ID NO: 850330 - protein, 208 aa, Homo sapiens [sequence omitted]

SEQ ID NO: 850331 - protein, 208 aa, Homo sapiens [sequence omitted]

SEQ ID NO: 850332 - protein, 480 aa, Homo sapiens; identical to SEQ ID NO: 850327

SEQ ID NO: 850333 - protein, 208 aa, Homo sapiens [sequence omitted]

SEQ ID NO: 850334 - protein, 208 aa, Homo sapiens [sequence omitted]

SEQ ID NO: 850335 - protein, 208 aa, Homo sapiens [sequence omitted]

SEQ ID NO: 850336 - protein, 462 aa, Homo sapiens
MSAGGPCPAAAGGGPGGASCSVGAPGGVSMFRWLEVLEKEFDKAFVDVDLLLGEIDPDQADITYEGRQKMTSLSSCFAQLCHKAQSVSQINHKLEAQLVDLKSELTETQAEKVVLEKEVHDQLLQLHSIQLQLHAKTGQSADSGTIKAKLSGPSVEELERELEANKKEKMKEAQLEAEVKLLRKENEALRRHIAVLQAEVYGARLAAKYLDKELAGRVQQIQLLGRDMKGPAHDKLWNQLEAEIHLHRHKTVIRACRGRNDLKRPMQAPPGHDQDSLKKSQGVGPIRKVLLLKEDHEGLGISITGGKEHGVPILISEIHPGQPADRCGGLHVGDAILAVNGVNLRDTKHKEAVTILSQQRGEIEFEVVYVAPEVDSDDENVEYEDESGHRYRLYLDELEGGGNPGASCKDTSGEIKVLQGFNKKAVTDTHENGDLGTASETPLDDGASKLDDLHTLYHKKSY

SEQ ID NO: 850337 - protein, 311 aa, Homo sapiens
MSAGGPCPAAAGGGPGGASCSVGAPGGVSMFRWLEVLEKEFDKAFVDVDLLLGEIDPDQADITYEGRQKMTSLSSCFAQLCHKAQSVSQINHKLEAQLVDLKSELTETQAEKVVLEKEVHDQLLQLHSIQLQLHAKTGQSADSGTIKAKLERELEANKKEKMKEAQLEAEVKLLRKENEALRRHIAVLQAEVYGARLAAKYLDKELAGRVQQIQLLGRDMKGPAHDKLWNQLEAEIHLHRHKTVIRACRGRNDLKRPMQAPPGHHARRIFVFLIETGFHHIVQAGLEPLTSGYPPTLASQSAGITGMSHCT

SEQ ID NO: 850338 - protein, 539 aa, Homo sapiens
MSAGGPCPAAAGGGPGGASCSVGAPGGVSMFRWLEVLEKEFDKAFVDVDLLLGEIDPDQADITYEGRQKMTSLSSCFAQLCHKAQSVSQINHKLEAQLVDLKSELTETQAEKVVLEKEVHDQLLQLHSIQLQLHAKTGQSADSGTIKAKLERELEANKKEKMKEAQLEAEVKLLRKENEALRRHIAVLQAEVYGARLAAKYLDKELAGRVQQIQLLGRDMKGPAHDKLWNQLEAEIHLHRHKTVIRACRGRNDLKRPMQAPPGHDQDSLKKSQGVGPIRKVLLLKEDHEGLGISITGGKEHGVPILISEIHPGQPADRCGGLHVGDAILAVNGVNLRDTKHKEAVTILSQQRGEIEFEVVYVAPEVDSDDENVEYEDESGHRYRLYLDELEGGGNPGASCKDTSGEIKVLQVWHRRLKNQKSAKEGVTVLINEDKELAELRGLAAGVGLANACYAIQYVALAIIMEHLGKGTLPTQEEIENLPAFPREKLTLRLLLGSGAFGEVYEGTAVDILGVGSGEIKVAVKTLKKGSTDQEKIEF

SEQ ID NO: 850339 - protein, 454 aa, Homo sapiens
MSAGGPCPAAAGGGPGGASCSVGAPGGVSMFRWLEVLEKEFDKAFVDVDLLLGEIDPDQADITYEGRQKMTSLSSCFAQLCHKAQSVSQINHKLEAQLVDLKSELTETQAEKVVLEKEVHDQLLQLHSIQLQLHAKTGQSADSGTIKAKLERELEANKKEKMKEAQLEAEVKLLRKENEALRRHIAVLQAEVYGARLAAKYLDKELAGRVQQIQLLGRDMKGPAHDKLWNQLEAEIHLHRHKTVIRACRGRNDLKRPMQAPPGHDQDSLKKSQGVGPIRKVLLLKEDHEGLGISITGGKEHGVPILISEIHPGQPADRCGGLHVGDAILAVNGVNLRDTKHKEAVTILSQQRGEIEFEVVYVAPEVDSDDENVEYEDESGHRYRLYLDELEGGGNPGASCKDTSGEIKVLQGFNKKAVTDTHENGDLGTASETPLDDGASKLDDLHTLYHKKSY

SEQ ID NO: 850340 - protein, 772 aa, Homo sapiens
MRLSSLLALLRPALPLILGLSLGCSLSLLRVSWIQGEGEDPCVEAVGERGGPQNPDSRARLDQSDEDFKPRIVPYYRDPNKPYKKVLRTRYIQTELGSRERLLVAVLTSRATLSTLAVAVNRTVAHHFPRLLYFTGQRGARAPAGMQVVSHGDERPAWLMSETLRHLHTHFGADYDWFFIMQDDTYVQAPRLAALAGHLSINQDLYLGRAEEFIGAGEQARYCHGGFGYLLSRSLLLRLRPHLDGCRGDILSARPDEWLGRCLIDSLGVGCVSQHQGQQYRSFELAKNRDPEKEGSSAFLSAFAVHPVSEGTLMYRLHKRFSALELERAYSEIEQLQAQIRNLTVLTPEGEAGLSWPVGLPAPFTPHSRFEVLGWDYFTEQHTFSCADGAPKCPLQGASRADVGDALETALEQLNRRYQPRLRFQKQRLLNGYRRFDPARGMEYTLDLLLECVTQRGHRRALARRVSLLRPLSRVEILPMPYVTEATRVQLVLPLLVAEAAAAPAFLEAFAANVLEPREHALLTLLLVYGPREGGRGAPDPFLGVKAAAAELERRYPGTRLAWLAVRAEAPSQVRLMDVVSKKHPVDTLFFLTTVWTRPGPEVLNRCRMNAISGWQAFFPVHFQEFNPALSPQRSPPGPPGAGPDPPSPPGADPSRGAPIGGRFDRQASAEGCFYNADYLAARARLAGELAGQEEEEALEGLEVMDVFLRFSGLHLFRAVEPGLVQKFSLRDCSPRLSEELYHRCRLSNLEGLGGRAQLAMALFEQEQANST

SEQ ID NO: 850341 - protein, 162 aa, Homo sapiens
MRLSSLLALLRPALPLILGLSLGCSLSLLRVSWIQGEGEDPCVEAVGERGGPQNPDSRARLDQSDEDFKPRIVPYYRDPNKPYKKVLRTRYIQTELGSRERLLVAVLTSRATLSIWLSLSRSRPIALSPPGGPNLITFPLSASAPGRARQDGGQIENCCCIF

SEQ ID NO: 850342 - protein, 345 aa, Homo sapiens
MRLSSLLALLRPALPLILGLSLGCSLSLLRVSWIQGEGEDPCVEAVGERGGPQNPDSRARLDQSDEDFKPRIVPYYRDPNKPYKKVLRTRYIQTELGSRERLLVAVLTSRATLSTLAVAVNRTVAHHFPRLLYFTGQRGARAPAGMQVVSHGDERPAWLMSETLRHLHTHFGADYDWFFIMQDDTYVQAPRLAALAGHLSINQDLYLGRAEEFIGAGEQARYCHGGFGYLLSRSLLLRLRPHLDGCRGDILSARPDEWLGRCLIDSLGVGCVSQHQGQQYRSFELAKNRDPEKEGSSAFLSAFAVHPVSEGTLMYRLHKRFSALELERAYSEIEQLQNCPKKAQG

SEQ ID NO: 850343 - protein, 844 aa, Homo sapiens
MRLSSLLALLRPALPLILGLSLGCSLSLLRVSWIQGEGEDPCVEAVGERGGPQNPDSRARLDQSDEDFKPRIVPYYRDPNKPYKKVLRTRYIQTELGSRERLLVAVLTSRATLSTLAVAVNRTVAHHFPRLLYFTGQRGARAPAGMQVVSHGDERPAWLMSETLRHLHTHFGADYDWFFIMQDDTYVQAPRLAALAGHLSINQDLYLGRAEEFIGAGEQARYCHGGFGYLLSRSLLLRLRPHLDGCRGDILSARPDEWLGRCLIDSLGVGCVSQHQGQQYRSFELAKNRDPEKEGSSAFLSAFAVHPVSEGTLMYRLHKRFSALELERAYSEIEQLQNCPKKAQGRRENSQVERQAWQRWSVDENKGGDYEEDVSPLGVGEKGCELLFQDTFTCAKSTFSTSFSWHLCKAQIRNLTVLTPEGEAGLSWPVGLPAPFTPHSRFEVLGWDYFTEQHTFSCADGAPKCPLQGASRADVGDALETALEQLNRRYQPRLRFQKQRLLNGYRRFDPARGMEYTLDLLLECVTQRGHRRALARRVSLLRPLSRVEILPMPYVTEATRVQLVLPLLVAEAAAAPAFLEAFAANVLEPREHALLTLLLVYGPREGGRGAPDPFLGVKAAAAELERRYPGTRLAWLAVRAEAPSQVRLMDVVSKKHPVDTLFFLTTVWTRPGPEVLNRCRMNAISGWQAFFPVHFQEFNPALSPQRSPPGPPGAGPDPPSPPGADPSRGAPIGGRFDRQASAEGCFYNADYLAARARLAGELAGQEEEEALEGLEVMDVFLRFSGLHLFRAVEPGLVQKFSLRDCSPRLSEELYHRCRLSNLEGLGGRAQLAMALFEQEQANST

SEQ ID NO: 850344 - protein, 420 aa, Homo sapiens
MRLSSLLALLRPALPLILGLSLGCSLSLLRVSWIQGEGEDPCVEAVGERGGPQNPDSRARLDQSDEDFKPRIVPYYRDPNKPYKKVLRTRYIQTELGSRERLLVAVLTSRATLSTLAVAVNRTVAHHFPRLLYFTGQRGARAPAGMQVVSHGDERPAWLMSETLRHLHTHFGADYDWFFIMQDDTYVQAPRLAALAGHLSINQDLYLGRAEEFIGAGEQARYCHGGFGYLLSRSLLLRLRPHLDGCRGDILSARPDEWLGRCLIDSLGVGCVSQHQGQQYRSFELAKNRDPEKEGSSAFLSAFAVHPVSEGTLMYRLHKRFSALELERAYSEIEQLQAQIRNLTVLTPEGEAGLSWPVGLPAPFTPHSRFEVLGWDYFTDSSIGAISPACASRSSDCSTAIGASTQHGAWSTPWTCCWNV

SEQ ID NO: 850345 - protein, 331 aa, Homo sapiens
MEYTLDLLLECVTQRGHRRALARRVSLLRPLSRVEILPMPYVTEATRVQLVLPLLVAEAAAAPAFLEAFAANVLEPREHALLTLLLVYGPREGGRGAPDPFLGVKAAAAELERRYPGTRLAWLAVRAEAPSQVRLMDVVSKKHPVDTLFFLTTVWTRPGPEVLNRCRMNAISGWQAFFPVHFQEFNPALSPQRSPPGPPGAGPDPPSPPGADPSRGAPIGGRFDRQASAEGCFYNADYLAARARLAGELAGQEEEEALEGLEVMDVFLRFSGLHLFRAVEPGLVQKFSLRDCSPRLSEELYHRCRLSNLEGLGGRAQLAMALFEQEQANST

SEQ ID NO: 850346 - protein, 772 aa, Homo sapiens; identical to SEQ ID NO: 850340

SEQ ID NO: 850347 - protein, 119 aa, Homo sapiens
FLPGPLLPPDHLSFSFSSRCWLMTDQDRIINLVVGSLTSLLILVTLISAFVFPQLPPKPLNIFFAVCISLSSITACILVSTVENLNSVLEGLSCNAQDKNFQPWVYTKGYLLIISSSSP

SEQ ID NO: 850348 - protein, 118 aa, Homo sapiens
MEDFATRTYGTSGLDNRPLFGETSAKDRIINLVVGSLTSLLILVTLISAFVFPQLPPKPLNIFFAVCISLSSITACILIYWYRQGDLEPKFRKLIYYIIFSIIMLCICANLYFHDVGR

SEQ ID NO: 850349 - protein, 134 aa, Homo sapiens
PTCDGGSGSGSGDLRRSREVIRSAATGPRDSSPTHLARVPGPRHRIPAGVWTQGPLSPARPGPPSVRAPRGCRAAQDEEVRGAGAEQSRSPRVSPHPSLAPALPRPLGFGYAGAVRRRLAVVDLRPREVMLSCF

SEQ ID NO: 850350 - protein, 134 aa, Homo sapiens; identical to SEQ ID NO: 850349

SEQ ID NO: 850351 - protein, 118 aa, Homo sapiens; identical to SEQ ID NO: 850348

SEQ ID NO: 850352 - protein, 108 aa, Homo sapiens
HSVPSSPRPRASARTGGDGANSQRGPIPPLAAVAEVAVAVPECEVRVSWGEEERQALLGPRSGAVRDQELSPTKSSLQPGEERGAVPGRELSPTGSCPKLRTDFRTRF

SEQ ID NO: 850353 - protein, 1836 aa, Homo sapiens
MSAKRPWPFSFPILFPLIPTIVCKDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQVGEVGTPSCNELRARPHNSLPVRPRPPWVHLGRVLPASVSFSLRSSPQLSVSWTNSCLPSQQPSIQCVELLDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQGVHPAFLGAQYPYSVTPPSLAATAVSFPVPSMAPITVHPYHTEPGLPLPTSVACELWGQGTVSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGVNYVHQFCVGAAKGVLSPFVLQEIVMETLQRLSPAHAHNHLRAPAFHQLVQRCQQAYMQYIHHRLIHLTPADYDDFVNAIRSARSAFCLTPMGMMQFNDILQNLKRSKQTKELWQRVSLEMATFSP

SEQ ID NO: 850354 - protein, 1803 aa, Homo sapiens
LCSFISEAESLCQNWRGWRKQSAGPNSPTGGGGGGGSGGTRMRDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQVGEVGTPSCNELRARPHNSLPVRPRPPWVHLGRVLPASVSFSLRSSPQLSVSWTNSCLPSQQPSIQCVELLDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRGPPGSSPNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQGVHPAFLGAQYPYSVTPPSLAATAVSFPVPSMAPITVHPYHTEPGLPLPTSVACELWGQGTVSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGVNYVHQFCVGAAKGVLSPFVLQEIVMETLQRLSPAHAHNHLRAPAFHQLVQRCQQAYMQYIHHRLIHLTPADYDDFVNAIRSARSAFCLTPMGMMQFNDILQNLKRSKQTKELWQRVSLEMATFSP

SEQ ID NO: 850355 - protein, 1608 aa, Homo sapiens
MGSPRPCSACLRLFLPQILPTAQRLLDELLSSQSTAINTVCGAPDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQGVHPAFLGAQYPYSVTPPSLAATAVSFPVPSMAPITVHPYHTEPGLPLPTSVACELWGQGTVSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGVNYVHQFCVGAAKGVLSPFVLQEIVMETLQRLSPAHAHNHLRAPAFHQLVQRCQQAYMQYIHHRLIHLTPADYDDFVNAIRSARSAFCLTPMGMMQFNDILQNLKRSKQTKELWQRVSLEMATFSP

SEQ ID NO: 850356 - protein, 1597 aa, Homo sapiens
LCSFISEAESLCQNWRGWRKQSAGPNSPTGGGGGGGSGGTRMRDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQVGEVGTPSCNELRARPHNSLPVRPRPPWVHLGRVLPASVSFSLRSSPQLSVSWTNSCLPSQQPSIQCVELLDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQVRPVFCWGVRHGKILGIHRGLEWVLWEYNWSVGESW

SEQ ID NO: 850357 - protein, 1597 aa, Homo sapiens; identical to SEQ ID NO: 850356

SEQ ID NO: 850358 - protein, 1842 aa, Homo sapiens
LCSFISEAESLCQNWRGWRKQSAGPNSPTGGGGGGGSGGTRMRDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQVGEVGTPSCNELRARPHNSLPVRPRPPWVHLGRVLPASVSFSLRSSPQLSVSWTNSCLPSQQPSIQCVELLDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQGVHPAFLGAQYPYSVTPPSLAATAVSFPVPSMAPITVHPYHTEPGLPLPTSVACELWGQGTVSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGVNYVHQFCVGAAKGVLSPFVLQEIVMETLQRLSPAHAHNHLRAPAFHQLVQRCQQAYMQYIHHRLIHLTPADYDDFVNAIRSARSAFCLTPMGMMQFNDILQNLKRSKQTKELWQRVSLEMATFSP

SEQ ID NO: 850359 - protein, 1492 aa, Homo sapiens
LCSFISEAESLCQNWRGWRKQSAGPNSPTGGGGGGGSGGTRMRDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQVGEVGTPSCNELRARPHNSLPVRPRPPWVHLGRVLPASVSFSLRSSPQLSVSWTNSCLPSQQPSIQCVELLDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGLSRLQWQRQQ

SEQ ID NO: 850360 - protein, 1597 aa, Homo sapiens; identical to SEQ ID NO: 850356

SEQ ID NO: 850361 - protein, 1462 aa, Homo sapiens
LCSFISEAESLCQNWRGWRKQSAGPNSPTGGGGGGGSGGTRMRDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQVGEVGTPSCNELRARPHNSLPVRPRPPWVHLGRVLPASVSFSLRSSPQLSVSWTNSCLPSQQPSIQCVELLDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCTAL

SEQ ID NO: 850362 - protein, 970 aa, Homo sapiens
LCSFISEAESLCQNWRGWRKQSAGPNSPTGGGGGGGSGGTRMRDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQVGEVGTPSCNELRARPHNSLPVRPRPPWVHLGRVLPASVSFSLRSSPQLSVSWTNSCLPSQQPSIQCVELLDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGFPAPKSQLEQRDTWG

SEQ ID NO: 850363 - protein, 967 aa, Homo sapiens
LCSFISEAESLCQNWRGWRKQSAGPNSPTGGGGGGGSGGTRMRDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQVGEVGTPSCNELRARPHNSLPVRPRPPWVHLGRVLPASVSFSLRSSPQLSVSWTNSCLPSQQPSIQCVELLDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGMMPDPTVSGELG

SEQ ID NO: 850364 - protein, 1855 aa, Homo sapiens
LCSFISEAESLCQNWRGWRKQSAGPNSPTGGGGGGGSGGTRMRDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQVGEVGTPSCNELRARPHNSLPVRPRPPWVHLGRVLPASVSFSLRSSPQLSVSWTNSCLPSQQPSIQCVELLDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQGVHPAFLGAQYPYSVTPPSLAATAVSFPVPSMAPITVHPYHTEPGLPLPTSVACELWGQGTVSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGVNYVHQFCVGAAKGVLSPFVLQEIVMETLQRLSPAHAHNHLRAPAFHQLVQRCQQAYMQYIHHRLIHLTPADYDDFVNAIRSARSAFCLTPMGMMQFNDILQNLKRSKQTKELWQRVSLEMATFSP

SEQ ID NO: 850365 - protein, 1792 aa, Homo sapiens
MSAKRPWPFSFPILFPLIPTIVCKDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQILPTAQRLLDELLSSQSTAINTVCGAPDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQGVHPAFLGAQYPYSVTPPSLAATAVSFPVPSMAPITVHPYHTEPGLPLPTSVACELWGQGTVSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGVNYVHQFCVGAAKGVLSPFVLQEIVMETLQRLSPAHAHNHLRAPAFHQLVQRCQQAYMQYIHHRLIHLTPADYDDFVNAIRSARSAFCLTPMGMMQFNDILQNLKRSKQTKELWQRVSLEMATFSP

SEQ ID NO: 850366 - protein, 1734 aa, Homo sapiens
FDRARVPSEQLGMKKDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQILPTAQRLLDELLSSQSTAINTVCGAPDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQGVHPAFLGAQYPYSVTPPSLAATAVSFPVPSMAPITVHPYHTEPGLPLPTSVACELWGQGTVSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGVNYVHQFCVGAAKGVLSPFVLQEIVMETLQRLSPAHAHNHLRAPAFHQLVQRCQQAYMQYIHHRLIHLTPADYDDFVNAIRSARSAFCLTPMGMMQFNDILQNLKRSKQTKELWQRVSLEMATFSP

SEQ ID NO: 850367 - protein, 1597 aa, Homo sapiens; identical to SEQ ID NO: 850356

SEQ ID NO: 850368 - protein, 1847 aa, Homo sapiens
LCSFISEAESLCQNWRGWRKQSAGPNSPTGGGGGGGSGGTRMRDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQVGEVGTPSCNELRARPHNSLPVRPRPPWVHLGRVLPASVSFSLRSSPQLSVSWTNSCLPSQQPSIQCVELLDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQGVHPAFLGAQYPYSVTPPSLAATAVSFPVPSMAPITVHPYHTEPGLPLPTSVALSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGVNYVHQFCVGAAKGVLSPFVLQEIVMETLQRLSPAHAHNHLRAPAFHQLVQRCQQAYMQYIHHRLIHLTPADYDDFVNAIRSARSAFCLTPMGMMQFNDILQNLKRSKQTKELWQRVSLEMATFSP

SEQ ID NO: 850369 - protein, 1597 aa, Homo sapiens; identical to SEQ ID NO: 850356

SEQ ID NO: 850370 - protein, 1929 aa, Homo sapiens
LCSFISEAESLCQNWRGWRKQSAGPNSPTGGGGGGGSGGTRMRDGLVIPLVELSAKQVAFHIPFEVVEKVYPPVPEQLQLRIAFWSFPENEEDIRLYSCLANGSADEFQRGDQLFRMRAVKDPLQIGFHLSATVVPPQMVPPKGAYNVAVMFDRCRVTSCSCTCGAGAKWCTHVVALCLFRIHNASAVCLRAPVSESLSRLQRDQLQKFAQYLISELPQQVGEVGTPSCNELRARPHNSLPVRPRPPWVHLGRVLPASVSFSLRSSPQLSVSWTNSCLPSQQPSIQCVELLDPTAGPSASDQSTWYLDESTLTDNIKKTLHKFCGPSPVVFSDVNSMYLSSTEPPAAAEWACLLRPLRGREPEGVWNLLSIVREMFKRRDSNAAPLLEILTDQCLTYEQITGWWYSVRTSASHSSASGHTGRSNGQSEVAAHACASMCDEMVTLWRLAVLDPALSPQRRRELCTQLRQWQLKVIENVKRGQHKKTLERLFPGFRPAVEACYFNWEEAYPLPGVTYSGTDRKLALCWARALPSRPGASRSGGLEESRDRPRPLPTEPAVRPKEPGTKRKGLGEGVPSSQRGPRRLSAEGGDKALHKMGPGGGKAKALGGAGSGSKGSAGGGSKRRLSSEDSSLEPDLAEMSLDDSSLALGAEASTFGGFPESPPPCPLHGGSRGPSTFLPEPPDTYEEDGGVYFSEGPEPPTASVGPPGLLPGDVCTQDDLPSTDESGNGLPKTKEAAPAVGEEDDDYQAYYLNAQDGAGGEEEKAEGGAGEEHDLFAGLKPLEQESRMEVLFACAEALHAHGYSSEASRLTVELAQDLLANPPDLKVEPPPAKGKKNKVSTSRQTWVATNTLSKAAFLLTVLSERPEHHNLAFRVGMFALELQRPPASTKALEVKLAYQESEVAALLKKIPLGPSEMSTMRCRAEELREGTLCDYRPVLPLMLASFIFDVLCAPGMMPDPTVSGELVVGVAFSKKDQEPQVSESPLGPIRQLHGWSVMMRILGSPVFFPMHDTSVCLTYPNFYYSGFSGSRPPSRNWNSETPGDEELGFEAAVAALGMKTTVSEAEHPLLCEGTRREKGDLALALMITYKDDQAKLKKILDKLLDRESQTHKPQTLSSFYSSSRPTTASQRSPSKHGGPSAPGALQPLTSGSAGPAQPGSVAGAGPGPTEGFTEKNVPESSPHSPCEGLPSEAALTPRPEGKVPSRLALGSRGGYNGRGWGSPGRPKKKHTGMASIDSSAPETTSDSSPTLSRRPLRGGWAPTSWGRGQDSDSISSSSSDSLGSSSSSGSRRASASGGARAKTVEVGRYKGRRPESHAPHVPNQPSEAAAHFYFELAKTVLIKAGGNSSTSIFTHPSSSGGHQGPHRNLHLCAFEIGLYALGLHNFVSPNWLSRTYSSHVSWITGQAMEIGSAALTILVECWDGHLTPPEVASLADRASRARDSNMVRAAAELALSCLPHAHALNPNEIQRALVQCKEQDNLMLEKACMAVEEAAKGGGVYPEVLFEVAHQWFWLYEQTAGGSSTAREGATSCSASGIRAGGEAGRGMPEGRGGPGTEPVTVAAAAVTAAATVVPVISVGSSLYPGPGLGHGHSPGLHPYTALQPHLPCSPQYLTHPAHPAHPMPHMPRPAVFPVPSSAYPQGVHPAFLGAQYPYSVTPPSLAATAVSFPVPSMAPITVHPYHTEPGLPLPTSVACELWGQGTVSSVHPASTFPAIQGASLPALTTQPSPLVSGGFPPPEEETHSQPVNPHSLHHLHAAYRVGMLALEMLGRRAHNDHPNNFSRSPPYTDDVKWLLGLAAKLGVNYVHQFCVGAAKGVLSPFVLQEIVMETLQRLSPAHAHNHLRAPAFHQLVQRCQQAYMQYIHHRLIHLTPADYDDFVNAIRSARSAFCLTPMGMMQFNDILQNLKRSKQTKELWQRVSLEMATFSP

SEQ ID NO: 850371 - protein, 967 aa, Homo sapiens; identical to SEQ ID NO: 850363

SEQ ID NO: 850372 - protein, 87 aa, Homo sapiens
MPLFGVYTYSMPILFPVAPQQPPAPCSHRRRELCTQLRQWQLKVIENVKRGQHKKTLERLFPGFRPAVEACYFNWEEAYPLPGVTYS

SEQ ID NO: 850373 - protein, 659 aa, Homo sapiens
LPLLHAGFNRRFMENSSIIACYNELIQIEHGEVRSQFKLRACNSVFTALDHCHEAIEITSDDHVIQYVNPAFERMMGYHKGELLGKELADLPKSDKNRADLLDTINTCIKKGKEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 850374 - protein, 612 aa, Homo sapiens
LPLLHAGFNRRFMENSSIIACYNELIQIEHGEVRSQFKLRACNSVFTALDHCHEAIEITSDDHVIQEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 850375 - protein, 659 aa, Homo sapiens; identical to SEQ ID NO: 850373

SEQ ID NO: 850376 - protein, 659 aa, Homo sapiens; identical to SEQ ID NO: 850373

SEQ ID NO: 850377 - protein, 86 aa, Homo sapiens
LGWAGLARGGLWLLPAVLLSFAQARGADRMGKCRGLRTARKLRSHRRDQKWHDKQYKKAHLGTALKGQPFWRCFSCKRNRAGKSRS

SEQ ID NO: 850378 - protein, 68 aa, Homo sapiens
LLPLTRLLPLTRLLALTRLLAPTLSLRPVAPTGWASVVDFVLLGSSVVTDETRSGMINSIRKLIWAQP

SEQ ID NO: 850379 - protein, 86 aa, Homo sapiens; identical to SEQ ID NO: 850377

SEQ ID NO: 850380 - protein, 86 aa, Homo sapiens; identical to SEQ ID NO: 850377

SEQ ID NO: 850381 - protein, 86 aa, Homo sapiens; identical to SEQ ID NO: 850377

SEQ ID NO: 850382 - protein, 86 aa, Homo sapiens; identical to SEQ ID NO: 850377

SEQ ID NO: 850383 - protein, 86 aa, Homo sapiens; identical to SEQ ID NO: 850377

SEQ ID NO: 850384 - protein, 86 aa, Homo sapiens; identical to SEQ ID NO: 850377

SEQ ID NO: 850385 - protein, 157 aa, Homo sapiens
MRLGAARAAPVGKWGTGATKRGPGETPAGRNWGLGSPHNKKGPGGNNRRLFSTTKSREGGGTRRRQKGGAALLQQGGLQKESDRAIKNIPRAVREKKERKKYKQTKDSEKRKTRHEENKEKETTDTARESRQRKKKDNEKARKKRSKTDNKKQEKNK

SEQ ID NO: 850386 - protein, 138 aa, Homo sapiens
MLVKKARRLKRGGTPVLGEKGLRTRALGRDISPKRDLNPFGGKGPGINQRRAERASLYKGLKVPRGITTSPGPDRQRATQRVKGAPKAKPEDKEEKGEHGGPGEKTGGCKGGTPRRDPGLGAEITPYTWGDTEAQVGE

SEQ ID NO: 850387 - protein, 86 aa, Homo sapiens; identical to SEQ ID NO: 850377

SEQ ID NO: 850388 - protein, 86 aa, Homo sapiens; identical to SEQ ID NO: 850377

SEQ ID NO: 850389 - protein, 68 aa, Homo sapiens; identical to SEQ ID NO: 850378

SEQ ID NO: 850390 - protein, 32 aa, Homo sapiens
MKFWLLDLVAKVMVGDIRGPLKGVRGHVAAWA

SEQ ID NO: 850391 - protein, 68 aa, Homo sapiens; identical to SEQ ID NO: 850378

SEQ ID NO: 850392 - protein, 68 aa, Homo sapiens; identical to SEQ ID NO: 850378

SEQ ID NO: 850393 - protein, 99 aa, Homo sapiens
ELARLQVRRQMGKCRGLRTARKLRSHRRDQKWHDKQYKKAHLGTALKGQPFWRCFSCKRNRAGKSRSEATAKSAIRKCVRLQLIKNGKKITAFVPMTFA

SEQ ID NO: 850394 - protein, 86 aa, Homo sapiens; identical to SEQ ID NO: 850377

SEQ ID NO: 850395 - protein, 86 aa, Homo sapiens; identical to SEQ ID NO: 850377

SEQ ID NO: 850396 - protein, 86 aa, Homo sapiens; identical to SEQ ID NO: 850377

SEQ ID NO: 850397 - protein, 86 aa, Homo sapiens; identical to SEQ ID NO: 850377

SEQ ID NO: 850398 - protein, 113 aa, Homo sapiens
MRTNRRVNPGSSCSGSEKFRKQEDGTEDGGQNETAKQSKDTRHPRPKENSNAEQQEKTRNRGHTEQKENTWGNKKKTTQANDSTTQANKNRRNKRQDEARREEQNKNTTKSET

SEQ ID NO: 850399 - protein, 86 aa, Homo sapiens; identical to SEQ ID NO: 850377

SEQ ID NO: 850400 - protein, 86 aa, Homo sapiens; identical to SEQ ID NO: 850377

SEQ ID NO: 850401 - protein, 86 aa, Homo sapiens; identical to SEQ ID NO: 850377

SEQ ID NO: 850402 - protein, 86 aa, Homo sapiens; identical to SEQ ID NO: 850377

SEQ ID NO: 850403 - protein, 171 aa, Homo sapiens
LRAILVGAGSQVRIPEHGSLSCRLYARMRGPMTYVLRSPRPLDCVTEGHSNQSLEATSRVDVSRRVIKQGLYSGRESIDELDYSRVELPLVIEKGIVLEKVGVEAKQPNSAIRKCVRVQLIKNGKKITAFVPNDGCLNFIGGTMMKFWLLDLVAKVMLLVIFLESALRLSK

SEQ ID NO: 850404 - protein, 86 aa, Homo sapiens; identical to SEQ ID NO: 850377

SEQ ID NO: 850405 - protein, 86 aa, Homo sapiens; identical to SEQ ID NO: 850377

SEQ ID NO: 850406 - protein, 120 aa, Homo sapiens
MHPNYGHGHHIHVPQTMSSHPRQAPERSAWELGIEAGVTAATYTPGALHPHLAHYHAPPRLHHLQLGALPLMVPDMAGYPHIRYISSGLDGTSFRGPFRGNFEVCNKINEYVCHSIFNAD

SEQ ID NO: 850407 - protein, 133 aa, Homo sapiens
MAGYPHIRYISSGLDGTSFRGPFRGNFEELIHLEERLGNVNRGASQGTIERCTYPHKYKKRKLHCKQDGEEGTEEDTEEKCTICLSILEEGEDVRRLPCMHLFHQVCVDQWLITNKKCPICRVDIEAQLPSES

SEQ ID NO: 850408 - protein, 208 aa, Homo sapiens
MHPNYGHGHHIHVPQTMSSHPRQAPERSAWELGIEAGVTAATYTPGALHPHLAHYHAPPRLHHLQLGALPLMVPDMAGYPHIRYISSGLDGTSFRGPFRGNFEELIHLEERLGNVNRGASQGTIERCTYPHKYKKRKLHCKQDGEEGTEEDTEEKCTICLSILEEGEDVRRLPCMHLFHQVCVDQWLITNKKCPICRVDIEAQLPSES

SEQ ID NO: 850409 - protein, 892 aa, Homo sapiens
RKSQQAGPSYVQNCVKENQGILGLRQHLGTPSDEDNDSSFSDCLSSPSSSLHFGDSDTVTSDEDKEVSVRHSQTILNAKSRSHSARSHKWPRTETESVSGLLMKRPCLHGSSLRRLPCRKRFVKNNSSQRTQKQKERILMQRKKREVLARRKYALLPSSSSSSENDLSSESSSSSSTEGEEDLFVSASENHQNNPAVPSGSIDEDVVVIEASSTPQVTANEEINVTSTDSEVEIVTVGESYRSRSTLGHSRSHWSQGSSSHASRPQEPRNRSRISTVIQPLRQNAAEVVDLTVDEDEPTVVPTTSARMESQATSASINNSNPSTSEQASDTASAVTSSQPSTVSETSATLTSNSTTGTSIGDDSRRTTSSAVTETGPPAMPRLPSCCPQHSPCGGSSQNHHALGHPHTSCFQQHGHHFQHHHHHHHTPHPAVPVSPSFSDPACPVERPPQVQAPCGANSSSGTSYHEQQALPVDLSNSGIRSHGSGSFHGASAFDPCCPVSSSRAAIFGHQAAAAAPSQPLSSIDGYGSSMVAQPQPQPPPQPSLSSCRHYMPPPYASLTRPLHHQASACPHSHGNPPPQTQPPPQVDYVIPHPVHAFHSQISSHATSHPVAPPPPTHLASTAAPIPQHLPPTHQPISHHIPATAPPAQRLHPHEVMQRMEVQRRRMMQHPTRAHERPPPHPHRMHPNYGHGHHIHVPQTMSSHPRQAPERSAWELGIEAGVTAATYTPGALHPHLAHYHAPPRLHHLQLGALPLMVPDMAGYPHIRYISSGLDGTSFRGPFRGNFEELIHLEERLGNVNRGASQGTIERCTYPHKYKKRKLHCKQDGEEGTEEDTEEKCTICLSILEEGEDVRRLPCMHLFHQVCVDQWLITNKKCPICRVDIEAQLPSES

SEQ ID NO: 850410 - protein, 900 aa, Homo sapiens
RKSQQAGPSYVQNCVKENQGILGLRQHLGTPSDEDNDSSFSDCLSSPSSSLHFGDSDTVTSDEDKEVSVRHSQTILNAKSRSHSARSHKWPRTETESVSGLLMKRPCLHGSSLRRLPCRKRFVKNNSSQRTQKQKERILMQRKKREVLARRKYALLPSSSSSSENDLSSESSSSSSTEGEEDLFVSASENHQNNPAVPSGSIDEDVVVIEASSTPQVTANEEINVTSTDSEVEIVTVGESYRSRSTLGHSRSHWSQGSSSHASRPQEPRNRSRISTVIQPLRQNAAEVVDLTVDEDEPTVVPTTSARMESQATSASINNSNPSTSEQASDTASAVTSSQPSTVSETSATLTSNSTTGTSIGDDSRRTTSSAVTETGPPAMPRLPSCCPQHSPCGGSSQNHHALGHPHTSCFQQHGHHFQHHHHHHHTPHPAVPVSPSFSDPACPVERPPQVQAPCGANSSSGTSYHEQQALPVDLSNSGIRSHGSGSFHGASAFDPCCPVSSSRAAIFGHQAAAAAPSQPLSSIDGYGSSMVAQPQPQPPPQPSLSSCRHYMPPPYASLTRPLHHQASACPHSHGNPPPQTQPPPQVDYVIPHPVHAFHSQISSHATSHPVAPPPPTHLASTAAPIPQHLPPTHQPISHHIPATAPPAQRLHPHEVMQRMEVQRRRMMQHPTRAHERPPPHPHRMHPNYGHGHHIHVPQTMSSHPRQAPERSAWELGIEAGVTAATYTPGALHPHLAHYHAPPRLHHLQLGALPLMVPDMAGYPHIRYISSGLDGTSFRGPFRGNFEELIHLEERLGNVNRGASQGTIERCTYPHKYKKVTTDWFSQRKLHCKQDGEEGTEEDTEEKCTICLSILEEGEDVRRLPCMHLFHQVCVDQWLITNKKCPICRVDIEAQLPSES

SEQ ID NO: 850411 - protein, 892 aa, Homo sapiens; identical to SEQ ID NO: 850409

SEQ ID NO: 850412 - protein, 426 aa, Homo sapiens
RKSQQAGPSYVQNCVKENQGILGLRQHLGTPSDEDNDSSFSDCLSSPSSSLHFGDSDTVTSDEDKEVSVRHSQTILNAKSRSHSARSHKWPRTETESVSGLLMKRPCLHGSSLRRLPCRKRFVKNNSSQRTQKQKERILMQRKKREVLARRKYALLPSSSSSSENDLSSESSSSSSTEGEEDLFVSASENHQNNPAVPSGSIDEDVVVIEASSTPQVTANEEINVTSTDSEVEIVTVGESYRSRSTLGHSRSHWSQGSSSHASRPQEPRNRSRISTVIQPLRQNAAEVVDLTVDEDEPTVVPTTSARMESQATSASINNSNPSTSEQASDTASAVTSSQPSTVSETSATLTSNSTTGTSIGDDSRRTTSSAVTETGPPAMPRLPSCCPQHSPCGGSSQNHHALGHPHTSCFQQHGHHFQHHHHHNF

SEQ ID NO: 850413 - protein, 203 aa, Homo sapiens
RKSQQAGPSYVQNCVKENQGILGLRQHLGTPSDEDNDSSFSDCLSSPSSSLHFGDSDTVTSDEDKEVSVRHSQTILNAKSRSHSARSHKWPRTETESVSGLLMKRPCLHGSSLRRLPCRKRFVKNNSSQRTQKQKERILMQRKKREVLARRKYALLPSSSSSSENDLSSESSSSSSTEGEEDLFVSASENHQNNPAVPSGKNV

SEQ ID NO: 850414 - protein, 892 aa, Homo sapiens; identical to SEQ ID NO: 850409

SEQ ID NO: 850415 - protein, 900 aa, Homo sapiens; identical to SEQ ID NO: 850410

SEQ ID NO: 850416 - protein, 240 aa, Homo sapiens
MFLISPIFLLLESLSLITNQTASQTRNCRIMVSDSSSTLLSEPWPRAGSERSAWELGIEAGVTAATYTPGALHPHLAHYHAPPRLHHLQLGALPLMVPDMAGYPHIRYISSGLDGTSFRGPFRGNFEELIHLEERLGNVNRGASQGTIERCTYPHKYKKVTTDWFSQRKLHCKQDGEEGTEEDTEEKCTICLSILEEGEDVRRLPCMHLFHQVCVDQWLITNKKCPICRVDIEAQLPSES

SEQ ID NO: 850417 - protein, 804 aa, Homo sapiens
RKSQQAGPSYVQNCVKENQGILGLRQHLGTPSDEDNDSSFSDCLSSPSSSLHFGDSDTVTSDEDKEVSVRHSQTILNAKSRSHSARSHKWPRTETESVSGLLMKRPCLHGSSLRRLPCRKRFVKNNSSQRTQKQKERILMQRKKREVLARRKYALLPSSSSSSENDLSSESSSSSSTEGEEDLFVSASENHQNNPAVPSGSIDEDVVVIEASSTPQVTANEEINVTSTDSEVEIVTVGESYRSRSTLGHSRSHWSQGSSSHASRPQEPRNRSRISTVIQPLRQNAAEVVDLTVDEDEPTVVPTTSARMESQATSASINNSNPSTSEQASDTASAVTSSQPSTVSETSATLTSNSTTGTSIGDDSRRTTSSAVTETGPPAMPRLPSCCPQHSPCGGSSQNHHALGHPHTSCFQQHGHHFQHHHHHHHTPHPAVPVSPSFSDPACPVERPPQVQAPCGANSSSGTSYHEQQALPVDLSNSGIRSHGSGSFHGASAFDPCCPVSSSRAAIFGHQAAAAAPSQPLSSIDGYGSSMVAQPQPQPPPQPSLSSCRHYMPPPYASLTRPLHHQASACPHSHGNPPPQTQPPPQVDYVIPHPVHAFHSQISSHATSHPVAPPPPTHLASTAAPIPQHLPPTHQPISHHIPATAPPAQRLHPHEVMQRMEVQRRRMMQHPTRAHERPPPHPHRMHPNYGHGHHIHVPQTMSSHPRQAPERSAWELGIEAGVTAATYTPGALHPHLAHYHAPPRLHHLQLGALPLMVPDMAGYPHIRYISSGLDGTSFRGPFRGNFEVCNKINEYVCHSIFNAD

SEQ ID NO: 850418 - protein, 300 aa, Homo sapiens
RKSQQAGPSYVQNCVKENQGILGLRQHLGTPSDEDNDSSFSDCLSSPSSSLHFGDSDTVTSDEDKEVSVRHSQTILNAKSRSHSARSHKWPRTETESVSGLLMKRPCLHGSSLRRLPCRKRFVKNNSSQRTQKQKERILMQRKKREVLARRKYALLPSSSSSSENDLSSESSSSSSTEGEEDLFVSASENHQNNPAVPSGSIDEDVVVIEASSTPQVTANEEINVTSTDSEVEIVTVGESYRSRSTLGHSRSHWSQGSSSHASRPQEPRNRSRISTVIQPLRQNAAEVVDLTVDEDGKLK

SEQ ID NO: 850419 - protein, 249 aa, Homo sapiens
WGVGQATVGKMAYQSLRLEYLQIPPVSRAYTTACVLTTAAVQLELITPFQLYFNPELIFKHFQIWRLITNFLFFGPVGFNFLFNMIFLYRYCRMLEEGSFRGRTADFVFMFLFGGFLMTLFGLFVSLVFLGQAFTIMLVYVWSRRNPYVRMNFFGLLNFQAPFLPWVLMGFSLLLGNSIIVDLLGIAVGHIYFFLEDVFPNQPGGIRILKTPSILKAIFDTPDEDPNYNPLPEERPGGFAWGEGQRLGG

SEQ ID NO: 850420 - protein, 147 aa, Homo sapiens
WGVGQATVGKMAYQSLRLEYLQIPPVSRAYTTACVLTTAAVQLELITPFQLYFNPELIFKHFQIWRLITNFLFFGPVGFNFLFNMIFLYRYCRMLEEGSFRGRTADFVFMFLFGGFLMTVSFNKQHGKMLKNTLALPKACHLSPTVL

SEQ ID NO: 850421 - protein, 101 aa, Homo sapiens
WGVGQATVGKMAYQSLRLEYLQIPPVSRAYTTACVLTTAAVQLELITPFQLYFNPELIFKHFQIWRLITNFLFFGPVGFNFLFNMIFLYPLLNGVSIKTFS

SEQ ID NO: 850422 - protein, 275 aa, Homo sapiens
VCGTRGCRKMAYHSFRLELTDIIASVTSCVRIILPSHMTVHIDPARRTRTRLRRISNTTQRICVRCSVSVSYYTWEILIPYLENDLYHRIWRLITNFLFFGPVGFNFLFNMIFLYRYCRMLEEGSFRGRTADFVFMFLFGGFLMTLFGLFVSLVFLGQAFTIMLVYVWSRRNPYVRMNFFGLLNFQAPFLPWVLMGFSLLLGNSIIVDLLGIAVGHIYFFLEDVFPNQPGGIRILKTPSILKAIFDTPDEDPNYNPLPEERPGGFAWGEGQRLGG

SEQ ID NO: 850423 - protein, 113 aa, Homo sapiens
MLVYVWSRRNPYVRMNFFGLLNFQAPFLPWVLMGFSLLLGNSIIVDLLGIAVGHIYFFLEDVFPNQPGGIRILKTPSILKAIFDTPDEDPNYNPLPEERPGGFAWGEGQRLGG

SEQ ID NO: 850424 - protein, 142 aa, Homo sapiens
MTERGRAGKLAVAGGDWQKEPVLTRFSRTLAGGEERQLELITPFQLYFNPELIFKHFQIWRLITNFLFFGPVGFNFLFNMIFLYRYCRMLEEGSFRGRTADFVFMFLFGGFLMTVSFNKQHGKMLKNTLALPKACHLSPTVL

SEQ ID NO: 850425 - protein, 228 aa, Homo sapiens
WGVGQATVGKMAYQSLRLEYLQIPPVSRAYTTACVLTTAAVQLELITPFQLYFNPELIFKHFQIWRLITNFLFFGPVGFNFLFNMIFLYRYCRMLEEGSFRGRTADFVFMFLFGGFLMTLFGLFVSLVFLGQAFTIMLVYVWSRRNPYVRMNFFGLLNFQAPFLPWVLMGFSLLLGNSIIVDLLGIAVGHIYFFLEDVFPNQPGGIRILKTPSIFPRISCFFKEPWFL

SEQ ID NO: 850426 - protein, 147 aa, Homo sapiens; identical to SEQ ID NO: 850420

SEQ ID NO: 850427 - protein, 80 aa, Homo sapiens
GLTVACGLTVACGLTVACGLTVAVWVDRGLEVKAAVPIMRPSWEGLGDTHWDLLSFVAKVWTLLTAWQILTPEALYEMVH

SEQ ID NO: 850428 - protein, 244 aa, Homo sapiens
MTERGRAGKLAVAGGDWQKEPVLTRFSRTLAGGEERQLELITPFQLYFNPELIFKHFQIWRLITNFLFFGPVGFNFLFNMIFLYRYCRMLEEGSFRGRTADFVFMFLFGGFLMTLFGLFVSLVFLGQAFTIMLVYVWSRRNPYVRMNFFGLLNFQAPFLPWVLMGFSLLLGNSIIVDLLGIAVGHIYFFLEDVFPNQPGGIRILKTPSILKAIFDTPDEDPNYNPLPEERPGGFAWGEGQRLGG

SEQ ID NO: 850429 - protein, 113 aa, Homo sapiens
WGVGQATVGKMAYQSLRLEYLQIPPVSRAYTTACVLTTAAVVSSCSATFSLSGLDMTGSSGNWGLGLGEAQRGWSRGWVEAYRDYSGVRVGAKNAYPVTREGSAASWGVSSWN

SEQ ID NO: 850430 - protein, 249 aa, Homo sapiens; identical to SEQ ID NO: 850419

SEQ ID NO: 850431 - protein, 147 aa, Homo sapiens; identical to SEQ ID NO: 850420

SEQ ID NO: 850432 - protein, 249 aa, Homo sapiens; identical to SEQ ID NO: 850419

SEQ ID NO: 850433 - protein, 201 aa, Homo sapiens
WGVGQATVGKMAYQSLRLEYLQIPPVSRAYTTACVLTTAAVQLELITPFQLYFNPELIFKHFQIWRLITNFLFFGPVGFNFLFNMIFLYRYCRMLEEGSFRGRTADFVFMFLFGGFLMTQSDRMSKSKELLTQAPFLPWVLMGFSLLLGNSIIVDLLGIAVGHIYFFLEDVFPNQPGGIRILKTPSIFPRISCFFKEPWFL

SEQ ID NO: 850434 - protein, 74 aa, Homo sapiens
RRHCSSRPAAVWRLRPVGAGGSGRGQPGVGKLVSMAKPSPPSVLFPVLPNLRYGLHQISASERIWKDIDPNFIQ

SEQ ID NO: 850435 - protein, 323 aa, Homo sapiens
MAEGERQPPPDSSEEAPPATQNFIIPKKEIHTVPDMGKWKRSQAYADYIGFILTLNEGVKGKKLTFEYRVSEAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAECLEKFPVIQHFKFGSLLPIHPVTSG

SEQ ID NO: 850436 - protein, 391 aa, Homo sapiens
HEGRKEEVTVQLSLPCPHMSSKLLEPAGAHLSSGSSEPLVEPGRGRVGARVKGERGLQASGSAPGRSKMAEGERQPPPDSSEEAPPATQNFIIPKKEIHTVPDMGKWKRSQAYADYIGFILTLNEGVKGKKLTFEYRVSEAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAECLEKFPVIQHFKFGSLLPIHPVTSG

SEQ ID NO: 850437 - protein, 323 aa, Homo sapiens; identical to SEQ ID NO: 850435

SEQ ID NO: 850438 - protein, 358 aa, Homo sapiens
MAEGERQPPPDSSEEAPPATQNFIIPKKEIHTVPDMGKWKRSQAYADYIGFILTLNEGVKGKKLTFEYRVSEMWNEVHEEKEQAAKQSVSCDECIPLPRAGHCAPSEAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAECLEKFPVIQHFKFGSLLPIHPVTSG

SEQ ID NO: 850439 - protein, 132 aa, Homo sapiens
MRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAECLEKFPVIQHFKFGSLLPIHPVTSG

SEQ ID NO: 850440 - protein, 323 aa, Homo sapiens; identical to SEQ ID NO: 850435

SEQ ID NO: 850441 - protein, 124 aa, Homo sapiens
SWRVRLFGKREDQEWSRPCACLFQLLWRPPLPHLLARPGWLLLQAPLPPIGPLFPACMAGRGLSDTWVWSYPPWSSCKLTLSSSLLALLVADEDWPICRALQPAVEHQRRPFLVQSEPGSHPHV

SEQ ID NO: 850442 - protein, 323 aa, Homo sapiens; identical to SEQ ID NO: 850435

SEQ ID NO: 850443 - protein, 323 aa, Homo sapiens; identical to SEQ ID NO: 850435

SEQ ID NO: 850444 - protein, 323 aa, Homo sapiens; identical to SEQ ID NO: 850435

SEQ ID NO: 850445 - protein, 413 aa, Homo sapiens
MAEGERQPPPDSSEEAPPATQNFIIPKKEIHTVPDMGKWKRSQAYADYIGFILTLNEGVKGKKLTFEYRVSEAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAEVSGGWPVCPSLLPHLVLGWGQSKRCGTWGSCFLLPHCFALNLRPAPLTLGASESPIWGMGSQRSTSHPSPEKLQSSSVLMSLEAEARTCCMGSGGDGGLPSPLSSGQRLLKARAV

SEQ ID NO: 850446 - protein, 114 aa, Homo sapiens
MGAPGRRTTTFVWIKHLLWCPLLVSLVGRGRLAQHPFGGAPTLGGAPPALFLIFDFSPTFGGMILAVFGGRPTRENLLVRPQVVATHHHTSCVLRLANTLRPPLRPSVPTYRVL

SEQ ID NO: 850447 - protein, 110 aa, Homo sapiens
IRFQLEGKELTGRRCAEPPHPRPSPQLLTEEPFTKGRFSGEWRGRNAASMKTGPFAEHSNQLWNISAVPSWSKVNQGLIRMYKAECLEKFPVIQHFKFGSLLPIHPVTSG

SEQ ID NO: 850448 - protein, 286 aa, Homo sapiens [sequence omitted]

SEQ ID NO: 850449 - protein, 77 aa, Homo sapiens
RSEAPGESVGTTPEAQMKTGPFAEHSNQLWNISAVPSWSKVNQGLIRMYKAECLEKFPVIQHFKFGSLLPIHPVTSG

SEQ ID NO: 850450 - protein, 148 aa, Homo sapiens
MAPGCLSSRFLPCRFGLPFLFLSLVGLVVEWVSLDRRSEELGEEGLGDPLAGLLPGPGMDTWELLRLLGSWQGCGVALTTLLTCSFLTVPGEVPCDPALQVREPAAHPSCHVGLGGAKPKSHPGHSSCACLPHPSSGPSPSPPSVRPV

SEQ ID NO: 850451 - protein, 323 aa, Homo sapiens; identical to SEQ ID NO: 850435

SEQ ID NO: 850452 - protein, 323 aa, Homo sapiens; identical to SEQ ID NO: 850435

SEQ ID NO: 850453 - protein, 621 aa, Homo sapiens
MSPVFPMLTVLTMFYYICLRRRARTATRGEMMNTHRAIESNSQTSPLNAEVVQYAKEVVDFSSHYGSENSMSYTMWNLAGVPNVFPSSGDFTQTAVFRTYGTWWDQCPSASLPFKRTPPNFQSQDYVELTFEQQVYPTAVHVLETYHPGAVIRILACSANPYSPNPPAEVRWEILWSERPTKVNASQARQFKPCIKQINFPTNLIRLEVNSSLLEYYTELDAVVLHGVKDKPVLSLKTSLIDMNDIEDDAYAEKDGCGMDSLNKKFSSAVLGEGPNNGYFDKLPYELIQLILNHLTLPDLCRLAQTCKLLSQHCCDPLQYIHLNLQPYWAKLDDTSLEFLQSRCTLVQWLNLSWTGNRGFISVAGFSRFLKVCGSELVRLELSCSHFLNETCLEVISEMCPNLQALNLSSCDKLPPQAFNHIAKLCSLKRLVLYRTKVEQTALLSILNFCSELQHLSLGSCVMIEDYDVIASMIGAKCKKLRTLDLWRCKNITENGIAELASGCPLLEELDLGWCPTLQSSTGCFTRLAHQLPNLQKLFLTANRSVCDTDIDELACNCTRLQQLDILGTRMVSPASLRKLLESCKDLSLLDVSFCSQIDNRAVLELNASFPKVFIKKSFTQ

SEQ ID NO: 850454 - protein, 617 aa, Homo sapiens
MSPVFPMLTVLTMFYYICLRRRARTATRGEMMNTHRAIESNSQTSPLNAEVVQYAKEVVDFSSHYGSENSMSYTMWNLAGVPNVFPSSGDFTQTAVFRTYGTWWDQCPSASLPFKRTPPNFQSQDYVELTFEQQVYPTAVHVLETYHPGAVIRILACSANPYSPNPPAEVRWEILWSERPTKVNASQARQFKPCIKQINFPTNLIRLEVNSSLLEYYTELDAVVLHGVKDKPVLSLKTSLIDMNDIEDDAYAEKDGCGMDSLNKKFSSAVLGEGPNNGYFDKLPYELIQLILNHLTLPDLCRLAQTCKLLSQHCCDPLQYIHLNLQPYWAKLDDTSLEFLQSRCTLVQWLNLSWTGNRGFISVAGFSRFLKVCGSELVRLELSCSHFLNETCLEVISEMCPNLQALNLSSCDKLPPQAFNHIAKLCSLKRLVLYRTKVEQTALLSILNFCSELQHLSLGSCVMIEDYDVIASMIGAKCKKLRTLDLWRCKNITENGIAELASGCPLLEELDLGWCPTLQSSTGCFTRLAHQLPNLQKLFLTANRSVCDTDIDELACNCTRLQQLDILGKVTIYKFVLNVCFLDRKANLRLFVRKKKIFGYNKNFILIRWLGLIGNAR

SEQ ID NO: 850455 - protein, 375 aa, Homo sapiens
MNDIEDDAYAEKDGCGMDSLNKKFSSAVLGEGPNNGYFDKLPYELIQLILNHLTLPDLCRLAQTCKLLSQHCCDPLQYIHLNLQPYWAKLDDTSLEFLQSRCTLVQWLNLSWTGNRGFISVAGFSRFLKVCGSELVRLELSCSHFLNETCLEVISEMCPNLQALNLSSCDKLPPQAFNHIAKLCSLKRLVLYRTKVEQTALLSILNFCSELQHLSLGSCVMIEDYDVIASMIGAKCKKLRTLDLWRCKNITENGIAELASGCPLLEELDLGWCPTLQSSTGCFTRLAHQLPNLQKLFLTANRSVCDTDIDELACNCTRLQQLDILGKVTIYKFVLNVCFLDRKANLRLFVRKKKIFGYNKNFILIRWLGLIGNAR

SEQ ID NO: 850456 - protein, 74 aa, Homo sapiens
RACGGCAASRESGSRPRTQAFSRCLVAGEARGARLSRTLQDFSSWPGSLAFSICFIRLDFQEALKLDRSLQSSS

SEQ ID NO: 850457 - protein, 621 aa, Homo sapiens; identical to SEQ ID NO: 850453

SEQ ID NO: 850458 - protein, 174 aa, Homo sapiens
MSPVFPMLTVLTMFYYICLRRRARTATRGEMMNTHRAIESNSQTSPLNAEVVQYAKEVVDFSSHYGSENSMSYTMWNLAGVPNVFPSSGDFTQTAVFRTYGTWWDQCPSASLPFKRTPPNFQSQDYVELTFEQQVYPTAVHVLETYHPGAVIRILACSANPYSPNPPAEVSLFS

SEQ ID NO: 850459 - protein, 171 aa, Homo sapiens [sequence omitted]

SEQ ID NO: 850460 - protein, 456 aa, Homo sapiens
MPGMICKNPDLEFDSLQPCFYPDEDDFYFGGPDSTPPGEDIWKKFELLPTPPLSPSRGFAEHSSEPPSWVTEMLLENELWGSPAEEDAFGLGGLGGLTPNPVILQDCMWSGFSAREKLERAVSEKLQHGRGPPTAGSTAQSPGAGAASPAGRGHGGAAGAGRAGAALPAELAHPAAECVDPAVVFPFPVNKREPAPVPAAPASAPAAGPAVASGAGIAAPAGAPGVAPPRPGGRQTSGGDHKALSTSGEDTLSDSDDEDDEEEDEEEEIDVVTVEKRRSSSNTKAVTTFTITVRPKNAALGPGRAQSSELILKRCLPIHQQHNYAAPSPYVESEDAPPQKKIKSEASPRPLKSVIPPKAKSLSPRNSDSEDSERRRNHNILERQRRNDLRSSFLTLRDHVPELVKNEKAAKVVILKKATEYVHSLQAEEHQLLLEKEKLQARQQQLLKKIEHARTC

SEQ ID NO: 850461 - protein, 418 aa, Homo sapiens
MPGMICKNPDLEFDSLQPCFYPDEDDFYFGGPDSTPPGEDIWKKFELLPTPPLSPSRGFAEHSSEPPSWVTEMLLENELWGSPAEEDAFGLGGLGGLTPNPVILQDCMWSGFSAREKLERAVSEKLQHGRGPPTAAGRRVRGSRRGLPLSREQARASARARSPGQCPGGGPCGRLGGGYCRPSRGPGGRPSAPRRPQTSGGDHKALSTSGEDTLSDSDDEDDEEEDEEEEIDVVTVEKRRSSSNTKAVTTFTITVRPKNAALGPGRAQSSELILKRCLPIHQQHNYAAPSPYVESEDAPPQKKIKSEASPRPLKSVIPPKAKSLSPRNSDSEDSERRRNHNILERQRRNDLRSSFLTLRDHVPELVKNEKAAKVVILKKATEYVHSLQAEEHQLLLEKEKLQARQQQLLKKIEHARTC

SEQ ID NO: 850462 - protein, 302 aa, Homo sapiens
FPLLSPSPLSAPQPPSLPAPRVCQIFQLIISPELQSAGCDSHLSGRAGWMRGAPGNCVGAEQALARRKRAQTVAIRGHPRPPGPPGDTRAESPPDPLQSAGDDEDDEEEDEEEEIDVVTVEKRRSSSNTKAVTTFTITVRPKNAALGPGRAQSSELILKRCLPIHQQHNYAAPSPYVESEDAPPQKKIKSEASPRPLKSVIPPKAKSLSPRNSDSEDSERRRNHNILERQRRNDLRSSFLTLRDHVPELVKNEKAAKVVILKKATEYVHSLQAEEHQLLLEKEKLQARQQQLLKKIEHARTC

SEQ ID NO: 850463 - protein, 456 aa, Homo sapiens; identical to SEQ ID NO: 850460

SEQ ID NO: 850464 - protein, 456 aa, Homo sapiens; identical to SEQ ID NO: 850460

SEQ ID NO: 850465 - protein, 373 aa, Homo sapiens
MPGMICKNPDLEFDSLQPCFYPDEDDFYFGGPDSTPPGEDIWKKFELLPTPPLSPSRGFAEHSSEPPSWVTEMLLENELWGSPAEEDAFGLGGLGGLTPNPVILQDCMWSGFSAREKLERAVSEKLQHGRGPPTAGSTAQSPGAGAASPAGRGHGGAAGAGRAGAALPAELAHPAAECVDPAVVFPFPVNKREPAPVPAAPASAPAAGPAVASGAGIAAPAGAPGVAPPRPGGRQTSGGDHKALSTSGEDTLSDSGKDRTRVRLPPWGTGPRVASPLLVLVCLGLGSILEAVLGAERSCFPQVSPRGKEKGLRECRCKRGALQFSPSLKFLPPSPGEPSSRPSRALTRSPTSLLQRSLRNKIGESWWLNRVGV

SEQ ID NO: 850466 - protein, 117 aa, Homo sapiens
MLLAQEEEECRRELLSWVPVPQPPRESCLDLLVDQPHSLLSILDAQTWLSQTEFGSCCPGWSAMVRSRLTATSTSQATDHTFLQKSHYHHGDHPSCTSPVSEWGPGRIWLGRGAREA

SEQ ID NO: 850467 - protein, 1530 aa, Homo sapiens
MKEASGVGGGHSPMCPPHCHMPPGPAGEWPGATVQQPRQRAPTALLQPDAAGPGGGGVSAGVAVLGACPSASEGVLPRPPGRSAPQPPEYPGRPDMAVPGWSAMVRSRLTATSTSQATDHTFLQKSHYHHGDHPSYAKPRLPLPVFTVRHYAGTVTYQVHKFLNRNRDQLDPAVVEMLGQSQLQLVGSLFQEAEPQSRGGRGRPTLASRFQQALEDLIARLGRSHVYFIQCLTPNPGKLPGLFDVGHVTEQLHQAAILEAVGTRSANFPVRVPFEAFLASFQALGSEGQEDLSDREKCGAVLSQVLGAESPLYHLGATKVLLQEQGWQRLEELRDQQRSQALVDLHRSFHTCISRQRVLPRMQARMRGFQARKRYLRRRAALGQLNTILLVAQPLLQRRQRLQLGRWQGWHSSERALERVPSMELGRLEIPAELAVMLKTAESHRDALAGSITECLPPEVPARPSLTLPADIDLFPFSSFVAIGFQEPSLPRPGQPLAKPLTQLDGDNPQRALDINKVMLRLLGDGSLESWQRQIMGAYLVRQGQCRPGLRNELFSQLVAQLWQNPDEQQSQRGWALMAVLLSAFPPLPVLQKPLLKFVSDQAPRGMAALCQHKLLGALEQSQLASGATRAHPPTQLEWLAGWRRGRMALDVFTFSEECYSAEVESWTTGEQLAGWILQSRGLEAPPRGWSVSLHSRDAWQDLAGCDFVLDLISQTEDLGDPARPRSYPITPLGSAEAIPLAPGIQAPSLPPGPPPGPAPTLPSRDHTGEVQRSGSLDGFLDQIFQPVISSGLSDLEQSWALSSRMKGGGAIGPTQQGYPMVYPGMIQMPAYQPGMVPAPMPMMPAMGTVPAMPAMVVPPQPPLPSLDAGQLAVQQQNFIQQQALILAQQMTAQAMSLSLEQQMQQRQQQARASEAASQASPSAVTSKPRKPPTPPEKPQRDLGSEGGCLRETSEEAEDRPYQPKSFQQKRNYFQRMGQPQITVRTMKPPAKVHIPQGEAQEEEEEEEEEEEQEEQEVETRAVPSPPPPPIVKKPLKQGGAKAPKEAEAEPAKETAAKAMAKGQPKAGGTVVRSSDSKPKRPQPSREIGNIIRMYQSRPGPVPVPVQPSRPPKAFLRKIDPKDEALAKLGINGAHSSPPMLSPSPGKGPPPAVAPRPKAPLQLGPSSSIKEKQGPLLDLFGQKLPIAHTPPPPPAPPLPLPEDPGTLSAERRCLTQPVEDQGVSTQLLAPSGSVCFSYTGTPWKLFLRKEVFYPRENFSHPYYLRLLCEQILRDTFSESCIRISQNERRKMKDLLGGLEVDLDSLTTTEDSVKKRIVVAARDNWANYFSRFFPVSGESGSDVQLLAVSHRGLRLLKVTQGPGLRPDQLKILCSYSFAEVLGVECRGGSTLELSLKSEQLVLHTARARAIEALVELFLNELKKDSGYVIALRSYITDNCSLLSFHRGDLIKLLPVATLEPGWQFGSAGGRSGLFPADIVQPAAAPDFSFSKEQRSGWHKGQLSNGEPGLARWDRASEVRKMGEGQAEARPA

SEQ ID NO: 850468 - protein, 1530 aa, Homo sapiens; identical to SEQ ID NO: 850467

SEQ ID NO: 850469 - protein, 1530 aa, Homo sapiens; identical to SEQ ID NO: 850467

SEQ ID NO: 850470 - protein, 701 aa, Homo sapiens
MELGRLEIPAELAVMLKTAESHRDALAGSITECLPPEVPARPSLTLPQNFIQQQALILAQQMTAQAMSLSLEQQMQQRQQQARASEAASQASPSAVTSKPRKPPTPPEKPQRDLGSEGGCLRETSEEAEDRPYQPKSFQQKRNYFQRMGQPQITVRTMKPPAKVHIPQGEAQEEEEEEEEEEEQEEQEVETRAVPSPPPPPIVKKPLKQGGAKAPKEAEAEPAKETAAKAMAKGQPKAGGTVVRSSDSKPKRPQPSREIGNIIRMYQSRPGPVPVPVQPSRPPKAFLRKIDPKDEALAKLGINGAHSSPPMLSPSPGKGPPPAVAPRPKAPLQLGPSSSIKEKQGPLLDLFGQKLPIAHTPPPPPAPPLPLPEDPGTLSAERRCLTQPVEDQGVSTQLLAPSGSVCFSYTGTPWKLFLRKEVFYPRENFSHPYYLRLLCEQILRDTFSESCIRISQNERRKMKDLLGGLEVDLDSLTTTEDSVKKRIVVAARDNWANYFSRFFPVSGESGSDVQLLAVSHRGLRLLKVTQGPGLRPDQLKILCSYSFAEVLGVECRGGSTLELSLKSEQLVLHTARARAIEALVELFLNELKKDSGYVIALRSYITDNCSLLSFHRGDLIKLLPVATLEPGWQFGSAGGRSGLFPADIVQPAAAPDFSFSKEQRSGWHKGQLSNGEPGLARWDRASEVRKMGEGQAEARPA

SEQ ID NO: 850471 - protein, 1530 aa, Homo sapiens; identical to SEQ ID NO: 850467

SEQ ID NO: 850472 - protein, 484 aa, Homo sapiens
GCLATSWRSQALLGQTDGGAAGKDTDSLVQYTKAPIQESLLSLSDDVSKLAVASFLALMRFMGDQSKPRGKDEMDLLYELLKLCQQEKLRDEIYCQVIKQVTGHPRPEHCTRGWSFLSLLTGFFPPSTRLMPYLTKFLQDSGPSQELARSSQEHLQRTVKYGGRRRMPPPGEMKAFLKGQAIRLLLIHLPGGVDYRTNIQTFTVAAEVQEELCRQMGITEPQEVQEFALFLIKEKSQLVRPLQPAEYLNSVVVDQDVSLHSRRLHWETPLHFDNSTYISTHYSQVLWDYLQGKLPVSAKADAQLARLAALQHLSKANRNTPSGQDLLAYVPKQLQRQVNTASIKNLMGQELRRLEGHSPQEAQISFIEAMSQLPLFGYTVYGVLRVSMQALSGPTLLGLNRQHLILMDPSSQSLYCRIALKSLQRLHLLSPLEEKGPPGLEVNYGSADNPQTIWFELPQAQELLYTTVFLIDSSASCTEWPSIN

SEQ ID NO: 850473 - protein, 1554 aa, Homo sapiens
MKEASGVGGGHSPMCPPHCHMPPGPAGEWPGATVQQPRQRAPTALLQPDAAGPGGGGVSAGVAVLGACPSASEGVLPRPPGRSAPQPPEYPGRPDMAVPGWSAMVRSRLTATSTSQATDHTFLQKSHYHHGDHPSYAKPRLPLPVFTVRHYAGTVTYQVHKFLNRNRDQLDPAVVEMLGQSQLQLVGSLFQEAEPQSRGGRGRPTLASRFQQALEDLIARLGRSHVYFIQCLTPNPGKLPGLFDVGHVTEQLHQAAILEAVGTRSANFPVRVPFEAFLASFQALGSEGQEDLSDREKCGAVLSQVLGAESPLYHLGATKVLLQEQGWQRLEELRDQQRSQALVDLHRSFHTCISRQRVLPRMQARMRGFQASLSSHIPPTAVGLTVCLIYPWARCWKRYLRRRAALGQLNTILLVAQPLLQRRQRLQLGRWQGWHSSERALERVPSMELGRLEIPAELAVMLKTAESHRDALAGSITECLPPEVPARPSLTLPADIDLFPFSSFVAIGFQEPSLPRPGQPLAKPLTQLDGDNPQRALDINKVMLRLLGDGSLESWQRQIMGAYLVRQGQCRPGLRNELFSQLVAQLWQNPDEQQSQRGWALMAVLLSAFPPLPVLQKPLLKFVSDQAPRGMAALCQHKLLGALEQSQLASGATRAHPPTQLEWLAGWRRGRMALDVFTFSEECYSAEVESWTTGEQLAGWILQSRGLEAPPRGWSVSLHSRDAWQDLAGCDFVLDLISQTEDLGDPARPRSYPITPLGSAEAIPLAPGIQAPSLPPGPPPGPAPTLPSRDHTGEVQRSGSLDGFLDQIFQPVISSGLSDLEQSWALSSRMKGGGAIGPTQQGYPMVYPGMIQMPAYQPGMVPAPMPMMPAMGTVPAMPAMVVPPQPPLPSLDAGQLAVQQQNFIQQQALILAQQMTAQAMSLSLEQQMQQRQQQARASEAASQASPSAVTSKPRKPPTPPEKPQRDLGSEGGCLRETSEEAEDRPYQPKSFQQKRNYFQRMGQPQITVRTMKPPAKVHIPQGEAQEEEEEEEEEEEQEEQEVETRAVPSPPPPPIVKKPLKQGGAKAPKEAEAEPAKETAAKAMAKGQPKAGGTVVRSSDSKPKRPQPSREIGNIIRMYQSRPGPVPVPVQPSRPPKAFLRKIDPKDEALAKLGINGAHSSPPMLSPSPGKGPPPAVAPRPKAPLQLGPSSSIKEKQGPLLDLFGQKLPIAHTPPPPPAPPLPLPEDPGTLSAERRCLTQPVEDQGVSTQLLAPSGSVCFSYTGTPWKLFLRKEVFYPRENFSHPYYLRLLCEQILRDTFSESCIRISQNERRKMKDLLGGLEVDLDSLTTTEDSVKKRIVVAARDNWANYFSRFFPVSGESGSDVQLLAVSHRGLRLLKVTQGPGLRPDQLKILCSYSFAEVLGVECRGGSTLELSLKSEQLVLHTARARAIEALVELFLNELKKDSGYVIALRSYITDNCSLLSFHRGDLIKLLPVATLEPGWQFGSAGGRSGLFPADIVQPAAAPDFSFSKEQRSGWHKGQLSNGEPGLARWDRASEVRKMGEGQAEARPA

SEQ ID NO: 850474 - protein, 587 aa, Homo sapiens
MKEASGVGGGHSPMCPPHCHMPPGPAGEWPGATVQQPRQRAPTALLQPDAAGPGGGGVSAGVAVLGACPSASEGVLPRPPGRSAPQPPEYPGRPDMAVPGWSAMVRSRLTATSTSQATDHTFLQKSHYHHGDHPSYAKPRLPLPVFTVRHYAGTVTYQVHKFLNRNRDQLDPAVVEMLGQSQLQLVGSLFQEAEPQSRGGRGRPTLASRFQQALEDLIARLGRSHVYFIQCLTPNPGKLPGLFDVGHVTEQLHQAAILEAVGTRSANFPVRVPFEAFLASFQALGSEGQEDLSDREKCGAVLSQVLGAESPLYHLGATKVLLQEQGWQRLEELRDQQRSQALVDLHRSFHTCISRQRVLPRMQARMRGFQASLSSHIPPTAVGLTVCLIYPWARCWKRYLRRRAALGQLNTILLVAQPLLQRRQRLQLGRWQGWHSSERALERVPSMELGRLEIPAELAVMLKTAESHRDALAGSITECLPPEVPARPSLTLPADIDLFPFSSFVAIGFQEVNDNLWETRTLPPSPEVEEGGQGGVYSGTALTKVEGNVIAHLRCSLVKVAGVVLGKQLGCSWQELVTAFPSRAGTP

SEQ ID NO: 850475 - protein, 383 aa, Homo sapiens
MKEASGVGGGHSPMCPPHCHMPPGPAGEWPGATVQQPRQRAPTALLQPDAAGPGGGGVSAGVAVLGACPSASEGVLPRPPGRSAPQPPEYPGRPDMAVPGWSAMVRSRLTATSTSQATDHTFLQKSHYHHGDHPSYAKPRLPLPVFTVRHYAGTVTYQVHKFLNRNRDQLDPAVVEMLGQSQLQLVGSLFQEAEPQSRGGRGRPTLASRFQQALEDLIARLGRSHVYFIQCLTPNPGKLPGLFDVGHVTEQLHQAAILEAVGTRSANFPVRVPFEAFLASFQALGSEGQEDLSDREKCGAVLSQVLGAESPLYHLGATKVLLQEQGWQRLEELRDQQRSQALVDLHRSFHTCISRQRVLPRMQARMRGFQASLSSHIPPTAVG

SEQ ID NO: 850476 - protein, 181 aa, Homo sapiens
RSLTVGPLPCPGVRWFGFCWGGRAGCVWSEQQWTQAPHAGQLVRPLQPAEYLNSVVVDQDVSLHSRRLHWETPLHFDNSTYISTHYSQVSLPASELLLQFEGAASCLGDLQSPSPHKGVGLWWLGGDSGKRRLEPLEPPTDGGLWTTAALLTVLPAQVLWDYLQGKLPVSAKADAQLARLA

SEQ ID NO: 850477 - protein, 1530 aa, Homo sapiens; identical to SEQ ID NO: 850467

SEQ ID NO: 850478 - protein, 1554 aa, Homo sapiens; identical to SEQ ID NO: 850473

SEQ ID NO: 850479 - protein, 1530 aa, Homo sapiens; identical to SEQ ID NO: 850467

SEQ ID NO: 850480 - protein, 624 aa, Homo sapiens
MRWDHPAVRLLWLPLCPLLMARLVSPARLCTPCRQGLGWMLLLCPTWYLVQGCPSRCLINSSSLSWLLVLLLWCLAGEGWGWGRTPGTGHWTLRWHQVSCDPSALPTLGARHTVTDSEATSLSSVAYAFLPDSHSYTMQEFARRYFRRSQALLGQTDGGAAGKDTDSLVQYTKAPIQESLLSLSDDVSKLAVASFLALMRFMGDQSKPRGKDEMDLLYELLKLCQQEKLRDEIYCQVIKQVTGHPRPEHCTRGWSFLSLLTGFFPPSTRLMPYLTKFLQDSGPSQELARSSQEHLQRTVKYGGRRRMPPPGEMKAFLKGQAIRLLLIHLPGGVDYRTNIQTFTVAAEVQEELCRQMGITEPQEVQEFALFLIKEKSQLVRPLQPAEYLNSVVVDQDVSLHSRRLHWETPLHFDNSTYISTHYSQVLWDYLQGKLPVSAKADAQLARLAALQHLSKANRNTPSGQDLLAYVPKQLQRQVNTASIKNLMGQELRRLEGHSPQEAQISFIEAMSQLPLFGYTVYGVLRVSMQALSGPTLLGLNRQHLILMDPSSQSLYCRIALKSLQRLHLLSPLEEKGPPGLEVNYGSADNPQTIWFELPQAQELLYTTVFLIDSSASCTEWPSIN

SEQ ID NO: 850481 - protein, 337 aa, Homo sapiens
MTASVNRWPRVNRCRVYRDVPRTTKVSVILKGQAIRLLLIHLPGGVDYRTNIQTFTVAAEVQEELCRQMGITEPQEVQEFALFLIKEKSQLVRPLQPAEYLNSVVVDQDVSLHSRRLHWETPLHFDNSTYISTHYSQVLWDYLQGKLPVSAKADAQLARLAALQHLSKANRNTPSGQDLLAYVPKQLQRQVNTASIKNLMGQELRRLEGHSPQEAQISFIEAMSQLPLFGYTVYGVLRVSMQALSGPTLLGLNRQHLILMDPSSQSLYCRIALKSLQRLHLLSPLEEKGPPGLEVNYGSADNPQTIWFELPQAQELLYTTVFLIDSSASCTEWPSIN

SEQ ID NO: 850482 - protein, 1437 aa, Homo sapiens
MKEASGVGGGHSPMCPPHCHMPPGPAGEWPGATVQQPRQRAPTALLQPDAAGPGGGGVSAGVAVLGACPSASEGVLPRPPGRSAPQPPEYPGRPDMAVPGWSAMVRSRLTATSTSQATDHTFLQKSHYHHGDHPSYAKPRLPLPVFTVRHYAGTVTYQVHKFLNRNRDQLDPAVVEMLGQSQLQLVGSLFQEAEPQSRGGRGRPTLASRFQQALEDLIARLGRSHVYFIQCLTPNPGKLPGLFDVGHVTEQLHQAAILEAVGTRSANFPVRVPFEAFLASFQALGSEGQEDLSDREKCGAVLSQVLGAESPLYHLGATKVLLQEQGWQRLEELRDQQRSQALVDLHRSFHTCISRQRVLPRMQARMRGFQASLSSHIPPTAVGLTVCLIYPWARCWKRYLRRRAALGQLNTILLVAQPLLQRRQRLQLGRWQGWHSSERALERVPSMELGRLEIPAELAVMLKTAESHRDALAGSITECLPPEVPARPSLTLPADIDLFPFSSFVAIGFQEPSLPRPGQPLAKPLTQLDGDNPQRALDINKVMLRLLGDGSLESWQRQIMGAYLVRQGQCRPGLRNELFSQLVAQLWQNPDEQQSQRGWALMAVLLSAFPPLPVLQKPLLKFVSDQAPRGMAALCQHKLLGALEQSQLASGATRAHPPTQLEWLAGWRRGRMALDVFTFSEECYSAEVESWTTGEQLAGWILQSRGLEAPPRGWSVSLHSRDAWQDLAGCDFVLDLISQTEDLGDPARPRSYPITPLGSAEAIPLAPGIQAPSLPPGPPPGPAPTLPSRDHTGEVQRSGSLDGFLDQIFQPVISSGLSDLEQSWALSSRMKGGGAIGPTQQGYPMVYPGMIQMPAYQPGMVPAPMPMMPAMGTVPAMPAMVVPPQPPLPSLDAGQLAVQQQNFIQQQALILAQQMTAQAMSLSLEQQMQQRQQQARASEAASQASPSAVTSKPRKPPTPPEKPQRDLGSEGGCLRETSEEAEDRPYQPKSFQQKRNYFQRMGQPQITVRTMKPPAKVHIPQGEAQEEEEEEEEEEEQEEQEVETRAVPSPPPPPIVKKPLKQGGAKAPKEAEAEPAKETAAKAMAKGQPKAGGTVVRSSDSKPKRPQPSREIGNIIRMYQSRPGPVPVPVQPSRPPKAFLRKIDPKDEALAKLGINGAHSSPPMLSPSPGKGPPPAVAPRPKAPLQLGPSSSIKEKQGPLLDLFGQKLPIAHTPPPPPAPPLPLPEDPGTLSAERRCLTQPVEDQGVSTQLLAPSGSVCFSYTGTPWKLFLRKEVFYPRENFSHPYYLRLLCEQILRDTFSESCIRISQNERRKMKDLLGGLEVDLDSLTTTEDSVKKRIVVAARDNWANYFSRFFPVSKSRERVCLGVASWLPGSGPQRASVEEFPALKVLLVAVSKDAAAVRLMSFLVGQMEVQRRPWLVKYGDSGEQIAGVPVG

SEQ ID NO: 850483 - protein, 74 aa, Homo sapiens
LALGSSRASWAVAGPRRLPETHHLPVGREWQRRAAVSRVPPWAATAQGDPRPRPPPRPAEDSLLIQVRWPTTLG

SEQ ID NO: 850484 - protein, 125 aa, Homo sapiens
MSTRRTRTRRPRISQQENGHCMDTNECIQFPFVCPRDKPVCVNTYGSYRCRTNKKCSRGYEPNEDGTACVGTLGQSPGPRPTTPTAAAATAAAAAAAGAATAAPVLVDGDLNLGSVVKESCEPSC

SEQ ID NO: 850485 - protein, 679 aa, Homo sapiens
AGIKRARGVGAGGSRPARDRGWEQAGGGAGGRGGSERPLPTPLGGGAESGRMAPSADPGMSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLETPMNASSSHSCALETSPYVSTPMEATGAGPTRSAVGATSPTRMAQPAWGLSASHRAPAPPPPPLLLPLPLLLPLLELPLLHRSS

SEQ ID NO: 850486 - protein, 645 aa, Homo sapiens
MAPSADPGMSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLECGQGFSQQENGHCMDTNECIQFPFVCPRDKPVCVNTYGSYRCRTNKKCSRGYEPNEDGTACVAQVAFLGGYSSAASRISEPLSRASYLSLGLGLCLQLYAL

SEQ ID NO: 850487 - protein, 610 aa, Homo sapiens
MAPSADPGMSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLETPMNASSSHSCALETSPYVSTPMEATGAGPTRSAVGATSPTRMAQPAWKEPCYLVSAISLENRMLL

SEQ ID NO: 850488 - protein, 712 aa, Homo sapiens
AGIKRARGVGAGGSRPARDRGWEQAGGGAGGRGGSERPLPTPLGGGAESGRMAPSADPGMSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLECGQGFSQQENGHCMDTNECIQFPFVCPRDKPVCVNTYGSYRCRTNKKCSRGYEPNEDGTACVGTLGQSPGPRPTTPTAAAATAAAAAAAGAATAAPVLVDGDLNLGSVVKESCEPSC

SEQ ID NO: 850489 - protein, 179 aa, Homo sapiens
CRQTGLLDSIAPERRDLKSVLFTISLALRTVLNSCFYSMDELVDADASAESLLLSSAADALSFCPSGKDEASSVEVTWPDGKMVSRNVASGEMNSVLEILYPRDEDTLQDPAPLECGQGFSQQENGHCMDTNECIQFPFVCPRDKVEPRDKVEPRDKVEPRDKVEPRDKVEPRDKVEPR

SEQ ID NO: 850490 - protein, 668 aa, Homo sapiens
AGIKRARGVGAGGSRPARDRGWEQAGGGAGGRGGSERPLPTPLGGGAESGRMAPSADPGMSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLECGQGFSQQENGHCMDTNECIQFPFVCPRDKPVCVNTYGSYRCRTNKKCSRGYEPNEDGTACVAQVASINTGYR

SEQ ID NO: 850491 - protein, 102 aa, Homo sapiens
MIPLSAVSRAVMLCGRGMISRFHVMPMKYRKNWTPRNHHKVITLPSLLGTFDSSTSTSQAAKKIVLNFMFCGFLSKIIDMEFAISPVRRICFGKNGSHMEVT

SEQ ID NO: 850492 - protein, 234 aa, Homo sapiens
MAASRWARKAVVLLCASDLLLLLLLLPPPGSCAAEGSPGTPDESTPPPRKKKKDIRDYNDADMARLLEQWEKDDDIEEGDLPEHKRPSAPVDFSKIDPSKPESILKMTKKGKTLMMFVTVSGSPTEKETEEITSLWQGSLFNANYDVQRFIVGSDRAIFMLRDGSYAWEIKDFLVGQDRCADVTLEGQVYPGKGGGSKEKNKTKQDKGKKKKEGDLKSRSSKEENRAGNKREDL

SEQ ID NO: 850493 - protein, 234 aa, Homo sapiens; identical to SEQ ID NO: 850492

SEQ ID NO: 850494 - protein, 234 aa, Homo sapiens; identical to SEQ ID NO: 850492

SEQ ID NO: 850495 - protein, 162 aa, Homo sapiens
ASSSFAGVHLAHKRPSAPVDFSKIDPSKPESILKMTKKGKTLMMFVTVSGSPTEKETEEITSLWQGSLFNANYDVQRFIVGSDRAIFMLRDGSYAWEIKDFLVGQDRCADVTLEGQVYPGKGGGSKEKNKTKQDKGKKKKEGDLKSRSSKEENRAGNKREDL

SEQ ID NO: 850496 - protein, 234 aa, Homo sapiens; identical to SEQ ID NO: 850492

SEQ ID NO: 850497 - protein, 251 aa, Homo sapiens
MAASRWARKAVVLLCASDLLLLLLLLPPPGSCAAEGSPGTPDESTPPPRKKKKDIRDYNDADMARLLEQWEKDDDIEEGDLPEHKRPSAPVDFSKIDPSKPESILKMTKKGKTLMMFVTVSGSPTEKETEEITSLWQGSLFNANYDVQRFIVGSDRAIFMLRDGSYAWEIKDFLVGQDRCADVTLEGQVYPGKGGGSKEKNKTKQDKGKKKKEGDLKSRSSKEENRAGLTTQTVRAHDACWGSDRHSCPQV

SEQ ID NO: 850498 - protein, 214 aa, Homo sapiens
NLRLGTRLGVMAEEALRGAAKMAASRWARKAVVLLCASDLLLLLLLLPPPGSCAAEGSPGTPDESTPPPRKKKKDIRDYNDADMARLLEQWEKDDDIEEGDLPEHKRPSAPVDFSKIDPSKPESILKMTKKGKTLMMFVTVSGSPTEKETEEITSLWQGSLFNANYDVQRLECSGVISAHCNLRLPGSSDSPASASRVAGTTGARHHAWLILYF

SEQ ID NO: 850499 - protein, 234 aa, Homo sapiens; identical to SEQ ID NO: 850492

SEQ ID NO: 850500 - protein, 234 aa, Homo sapiens; identical to SEQ ID NO: 850492

SEQ ID NO: 850501 - protein, 234 aa, Homo sapiens; identical to SEQ ID NO: 850492

SEQ ID NO: 850502 - protein, 234 aa, Homo sapiens; identical to SEQ ID NO: 850492

SEQ ID NO: 850503 - protein, 234 aa, Homo sapiens; identical to SEQ ID NO: 850492

SEQ ID NO: 850504 - protein, 234 aa, Homo sapiens; identical to SEQ ID NO: 850492

SEQ ID NO: 850505 - protein, 136 aa, Homo sapiens
MAASRWARKAVVLLCASDLLLLLLLLPPPGSCAAEGSPGTPDESTPPPRKKKKDIRDYNDADMARLLEQWETPEPLPVLPEVPSTCACLSSASLIWTCFSHLSPHALVKRVWLQPNRAWEEKRVLLLPGFPIGEGS

SEQ ID NO: 850506 - protein, 492 aa, Homo sapiens
MEDQAGQRDYDLLVVGGGSGGLACAKEAAQLGRKVSVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPTAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGC

SEQ ID NO: 850507 - protein, 520 aa, Homo sapiens
MVLQRSTALLPTVEVDKHCTEKKKRLGPIWIGSGQRDYDLLVVGGGSGGLACAKEAAQLGRKVSVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPTAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGC

SEQ ID NO: 850508 - protein, 585 aa, Homo sapiens
IPHTLSQCSTLGLKAPAPNPAAFGPGLASALTSPATARPGLDPPRSGAGSAAGSPSCPRSPTTMAAMAVALRGLGGRFRWRTQAVAGGVRGAARGAAAGQRDYDLLVVGGGSGGLACAKEAAQLGRKVSVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPTAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGC

SEQ ID NO: 850509 - protein, 150 aa, Homo sapiens
MAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGC

SEQ ID NO: 850510 - protein, 172 aa, Homo sapiens
MPLRRTSSRGNAGRPELTPTAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGC

SEQ ID NO: 850511 - protein, 209 aa, Homo sapiens
CTRSLSGHSEKQFKHNRSEVKATEDNLSAPSLFPSGRVPDTRSLNLEKAGVDTSPDTQKILVDSREATSVPHIYAIGDVVEVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGC

SEQ ID NO: 850512 - protein, 585 aa, Homo sapiens; identical to SEQ ID NO: 850508

SEQ ID NO: 850513 - protein, 172 aa, Homo sapiens; identical to SEQ ID NO: 850510

SEQ ID NO: 850514 - protein, 46 aa, Homo sapiens
MISWWSAGDLVAWLVPRRVCILYTSWQGLEAFRAPREGGAVQKTSM

SEQ ID NO: 850515 - protein, 585 aa, Homo sapiens; identical to SEQ ID NO: 850508

SEQ ID NO: 850516 - protein, 423 aa, Homo sapiens
MVAAYLLVHLSHSIQALLGAGAPFYQCSLLIQLVRFNLQRKCLKILSLSFRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPTAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGC

SEQ ID NO: 850517 - protein, 1278 aa, Homo sapiens
MPPPPSANRACVGLARGQCLLGEGSQRHKLCHEGDALLKQSLGMGNQKGNQPGAAEASLLCSGHKRRGDDRGGPEMPERTQGSWPGGDQYSKSNVLSHVVKVDFKYVYYDKHYEGLGNILDSGVYLMVLILNSTLFFFQNLSSYCHSQINSTLKGRWRVSPSHRALALLLCLLTPPFTHSIRELLPLNRGAALDQAHRDVADQWAGGCVPGKPGRQPGRQQARPLPTQQSCRGLHAHPPLLGVCFIFLYFQNEHPPDSLPGMIDAGGGSFSQSLASDPASRGRLRLLRACWGPLGHVLTSLLLRARFCKHSGATSQVSNCERFLLVCTKAFNQALFLLAIKDDPLWEVKIKRPRGGTAGNANISDSASCTGCALRPHKLGSDRKGGCLRARCTHTQKGPRCCTELPCGAECWPCPLPVCLAPGRSWRGPWTLALRSGPCSLEAEEDQSPFLDAALISTWWIKHIEQLKQLIAVQGAPAHCLSLNHPPTPGVSDNRLGTSVRRISCLQMCRYSAEWRQSASTAAGSNSPAELTSCGLNPWLSRGAGPGWGILSKRLPVQGLLSAVKFRFGFKEGTDCLWTAALKNWKLSLHVPLWRPQPLWMVLCPSLEGEMLKALAYPSLHHRSPAHGQKSQQTQEGTRYTWGSHSQAAVVPECQGGWPQVCLGPCDMAGETRPREGIRLDLTPATEAISSLGFILDNSEMSTCVYNQHQSLKHNMHGAWELGFPASSWHHTEATPTACPCIVSPTWHVCLDHSQRDWGAQEMMMGAGGAQEGSCCQGGLQPWAPLSTQALFAGMYRQATVFAQLCSADGSRTPQTQLHKSLRIVPLLSARQQERAESKNQAGDGWEHPKPGEREGAAPPGCPLCWCGCSWGLGAAVGVDAARARGLRWAHQDCSQGCALLQLRETKFVAMLFPVGMGPAVTLASTCLHALRVEWPSLSSDTDRRPLFDSLTPFYFSANLVCELMTSRETQICLHCEFDIFGSGAKMNIHGALPMSGGCGLPLHTTWPRACAAAPETALLAQPQLMVVLTPHRGQARVAGGSALCLPTSLVPHAWLEGKFTLMSRAHSYLTGQPAPAYMVVQLGLVTMTNSVLNELELSGNQLKKKEQHGEKSSRDRSAPFMHITMHPLMSAGALGQPTCYNCNYVNKLLKGRVRWLMPVIPHFGMPRWEDHLSPGVQDQPEQQSETSFQIINNNNNNNNCFLFVFETVSSSVAQVGVQERDLAHRNLHLPNSSDSPASAFQVAGITGTRHRAQLIFVFLVETGFHCVSQAGLELLTS

SEQ ID NO: 850518 - protein, 301 aa, Homo sapiens
MAFSGIYVALECAGFLTGIGLDTTIMMRSIPLRGFDQQMSSMVIEHMASHGTRFLRGCAPSRVRRLPDGQLQVTWEDSTTGKEDTGTFDTVLWAIGRVPDTRSLNLEKAGVDTSPDTQKILVDSREATSVPHIYAIGDVVEGRPELTPTAIMAGRLLVQRLFGGSSDLMDYDNVPTTVFTPLEYGCVGLSEEEAVARHGQEHVEVYHAHYKPLEFTVAGRDASQCYVKMVCLREPPQLVLGLHFLGPNAGEVTQGFALGIKCGASYAQVMRTVGIHPTCSEEVVKLRISKRSGLDPTVTGC

SEQ ID NO: 850519 - protein, 585 aa, Homo sapiens; identical to SEQ ID NO: 850508

SEQ ID NO: 850520 - protein, 403 aa, Homo sapiens
IPHTLSQCSTLGLKAPAPNPAAFGPGLASALTSPATARPGLDPPRSGAGSAAGSPSCPRSPTTMAAMAVALRGLGGRFRWRTQAVAGGVRGAARGAAAGQRDYDLLVVGGGSGGLACAKEAAQLGRKVSVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGVSDNRLGTSVRRISCLQMCRLQR

SEQ ID NO: 850521 - protein, 401 aa, Homo sapiens
IPHTLSQCSTLGLKAPAPNPAAFGPGLASALTSPATARPGLDPPRSGAGSAAGSPSCPRSPTTMAAMAVALRGLGGRFRWRTQAVAGGVRGAARGAAAGQRDYDLLVVGGGSGGLACAKEAAQLGRKVSVVDYVEPSPQGTRWGLGGTCVNVGCIPKKLMHQAALLGGLIQDAPNYGWEVAQPVPHDWRKMAEAVQNHVKSLNWGHRVQLQDRKVKYFNIKASFVDEHTVCGVAKGGKEILLSADHIIIATGGRPRYPTHIEGALEYGITSDDIFWLKESPGKTLVVGASYVALECAGFLTGIGLDTTIMMRSIPLRGFDQQMSSMVIEHMASHGTRFLRGCAPSRVRRLPDGQLQVTWEDSTTGKEDTGTFDTVLWAIGLPHPAGCQAGWPLPSAPREQP

SEQ ID NO: 850522 - protein, 574 aa, Homo sapiens
MGNNFSSIPSLPRGNPSRAPRGHPQNLKDSIGGPFPVTSHRCHHKQKHCPAVLPSGGLPATPLLFHPHTKGSQILMDLSHKAVKRQASFCNAITFSNRPVLIYEQVRLKITKKQCCWSGALRLGFTSKDPSRIHPDSLPKYACPDLVSQSGFWAKALPEEFANEGNIIAFWVDKKGRVFHRINDSAVMLFFSGVRTADPLWALVDVYGLTRGVQLLDSELVLPDCLRPRSFTALRRPSLRREADDARLSVSLCDLNVPGADGDEAAPAAGCPIPQNSLNSQHSRALPAQLDGDLRFHALRAGAHVRILDEQTVARVEHGRDERALVFTSRPVRVAETIFVKVTRSGGARPGALSFGVTTCDPGTLRPADLPFSPEALVDRKEFWAVCRVPGPLHSGDILGLVVNADGELHLSHNGAAAGMQLCVDASQPLWMLFGLHGTITQIRILGSTILAERGIPSLPCSPASTPTSPSALGSRLSDPLLSTCSSGPLGSSAGGTAPNSPVSLPESPVTPGLGQWSDECTICYEHAVDTVIYTCGHMCLCYACGLRLKKALHACCPICRRPIKDIIKTYRSS

SEQ ID NO: 850523 - protein, 574 aa, Homo sapiens; identical to SEQ ID NO: 850522

SEQ ID NO: 850524 - protein, 466 aa, Homo sapiens [sequence omitted]

SEQ ID NO: 850525 - protein, 489 aa, Homo sapiens
RREAALGLIDQVGEGGLRPPPATQITKKQCCWSGALRLGFTSKDPSRIHPDSLPKYACPDLVSQSGFWAKALPEEFANEGNIIAFWVDKKGRVFHRINDSAVMLFFSGVRTADPLWALVDVYGLTRGVQLLDSELVLPDCLRPRSFTALRRPSLRREADDARLSVSLCDLNVPGADGDEAAPAAGCPIPQNSLNSQHSRALPAQLDGDLRFHALRAGAHVRILDEQTVARVEHGRDERALVFTSRPVRVAETIFVKVTRSGGARPGALSFGVTTCDPGTLRPADLPFSPEALVDRKEFWAVCRVPGPLHSGDILGLVVNADGELHLSHNGAAAGMQLCVDASQPLWMLFGLHGTITQIRILGSTILAERGIPSLPCSPASTPTSPSALGSRLSDPLLSTCSSGPLGSSAGGTAPNSPVSLPESPVTPGLGQWSDECTICYEHAVDTVIYTCGHMCLCYACGLRLKKALHACCPICRRPIKDIIKTYRSS

SEQ ID NO: 850526 - protein, 367 aa, Homo sapiens [sequence omitted]

SEQ ID NO: 850527 - protein, 252 aa, Homo sapiens
MGNNFSSIPSLPRGNPSRAPRGHPQNLKDSIGGPFPVTSHRCHHKQKHCPAVLPSGGLPATPLLFHPHTKGSQILMDLSHKAVKRQASFCNAITFSNRPVLIYEQVRLKITKKQCCWSGALRLGFTSKDPSRIHPDSLPKYACPDLVSQSGFWAKALPEEFANEGNIIAFWVDKKGRVFHRINDSAVMLFFSGVRTADPLWALVDVYGLTRGVQLLGLDTRQERGQWPSCAFQSRAYKSSRHQGSTAHVGHR

SEQ ID NO: 850528 - protein, 574 aa, Homo sapiens; identical to SEQ ID NO: 850522

SEQ ID NO: 850529 - protein, 577 aa, Homo sapiens
FGTVTSRPAQQRWLHCPSPEMGGQITRSTLHDSIGGPFPVTSHRCHHKQKHCPAVLPSGGLPATPLLFHPHTKGSQILMDLSHKAVKRQASFCNAITFSNRPVLIYEQVRLKITKKQCCWSGALRLGFTSKDPSRIHPDSLPKYACPDLVSQSGFWAKALPEEFANEGNIIAFWVDKKGRVFHRINDSAVMLFFSGVRTADPLWALVDVYGLTRGVQLLDSELVLPDCLRPRSFTALRRPSLRREADDARLSVSLCDLNVPGADGDEAAPAAGCPIPQNSLNSQHSRALPAQLDGDLRFHALRAGAHVRILDEQTVARVEHGRDERALVFTSRPVRVAETIFVKVTRSGGARPGALSFGVTTCDPGTLRPADLPFSPEALVDRKEFWAVCRVPGPLHSGDILGLVVNADGELHLSHNGAAAGMQLCVDASQPLWMLFGLHGTITQIRILGSTILAERGIPSLPCSPASTPTSPSALGSRLSDPLLSTCSSGPLGSSAGGTAPNSPVSLPESPVTPGLGQWSDECTICYEHAVDTVIYTCGHMCLCYACGLRLKKALHACCPICRRPIKDIIKTYRSS

SEQ ID NO: 850530 - protein, 367 aa, Homo sapiens [sequence omitted]

SEQ ID NO: 850531 - protein, 466 aa, Homo sapiens [sequence omitted]

SEQ ID NO: 850532 - protein, 102 aa, Homo sapiens
MGDTPSSSTSWISSKVTGCVLKRDWRGRSRPGPWAAWRAHGLRELVGQAHEVRHHRLVTGADAHQLAGLGGHGASGVCGAGRRGAGALRGRPQCFFFFFFLQ

SEQ ID NO: 850533 - protein, 102 aa, Homo sapiens; identical to SEQ ID NO: 850532

SEQ ID NO: 850534 - protein, 102 aa, Homo sapiens; identical to SEQ ID NO: 850532

SEQ ID NO: 850535 - protein, 225 aa, Homo sapiens
HCANILTLFVSFQEPHRHIQVKRSLNKCLQPSQCKNKYQSSRRSSSRAAPKVPTATPNNYKSVQRECWRECEWVCAGGHGGAVCKIGVANHRTRAWSGYPPPILGLLLLHGGHPLLLHLLDLVEGHRLRLEARLARPQPARPLGSLAGARAAGTRRPGTRSAASPPGNWSRCPSARRAWRPWRLRRLRGRAAGRRGSPRAAAMLFFFFFFTMRIIIHLYFHNSLQ

SEQ ID NO: 850536 - protein, 207 aa, Homo sapiens
FFCAILYCPDYYGSRARHIQVKRSLNKCLQPSQCKNKYQSSRRSSSRGVAGVQAVPQFAAAELLPLQRQALRAAAQALQALQERLLGLLLLHGGHPLLLHLLDLVEGHRLRLEARLARPQPARPLGSLAGARAAGTRRPGTRSAASPPGNWSRCPSARRAWRPWRLRRLRGRAAGRRGSPRAAAMLFFFFFFTMRIIIHLYFHNSLQ

SEQ ID NO: 850537 - protein, 102 aa, Homo sapiens; identical to SEQ ID NO: 850532

SEQ ID NO: 850538 - protein, 102 aa, Homo sapiens; identical to SEQ ID NO: 850532

SEQ ID NO: 850539 - protein, 264 aa, Homo sapiens
HCANILTLFVSFQEPHRHIQVKRSLNKCLQPSQCKNKYQSSRRSSSRAAPKVPTATPNNYKSVQRECWRECEWVCAGGHGGAVCKIGVANHRTRAWSGYPPPTQRGRASPHTLTAEFAESLESRLFLSLQLLSCSRCSDRLCVLRRRHSRLCRNDFLAFSSSMGDTPSSSTSWISSKVTGCVLKRDWRGRSRPGPWAAWRAHGLRELVGQAHEVRHHRLVTGADAHQLAGLGGHGASGVCGAGRRGAGALRGRPQCFFFFFFLQ

SEQ ID NO: 850540 - protein, 52 aa, Homo sapiens
APGPPGRQQPGARRAGDPNLLRGGGGLAGPGRRSSGGRAGGRTRRGARGSGG

SEQ ID NO: 850541 - protein, 1429 aa, Homo sapiens
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGLDQTTLSDEMRQELRALEQEKPQLLIFSRRKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKELELCYRSPGEDQLFSEFYVGHLGSGIRLQVKDKKDETLVWEALVKPGDLMPATTLIPPARIAVPSPLDAPQLLHFVDQYREQLIARVTSVEVVLDKLHGQVLSQEQYERVLAENTRPSQMRKLFSLSQSWDRKCKDGLYQALKETHPHLIMELWEKGSKKGLLPLSS

SEQ ID NO: 850542 - protein, 1429 aa, Homo sapiens; identical to SEQ ID NO: 850541

SEQ ID NO: 850543 - protein, 1386 aa, Homo sapiens
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGLDQTTLSDEMRQELRALEQEKPQLLIFSRRKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKAIDDLEMKFQFVRIHKPPPLTPLYMGCRYTVSGSGSGMLEILPKELELCYRSPGEDQLFSEFYVGHLGSGIRLQVKDKKDETLVWEALVKPGDLMPATTLIPPARIGRNTSQPWNLRCNRDARRY

SEQ ID NO: 850544 - protein, 610 aa, Homo sapiens
MYFSSFTKLKFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGLDQTTLSDEMRQELRALEQEKPQLLIFSRRKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKAIDDLEMKFQFVRIHKPPPLTPLYMGCRYTVSGSGSGMLEILPKELELCYRSPGEDQLFSEFYVGHLGSGIRLQVKDKKDETLVWEALVKPGDLMPATTLIPPARIGRNTSQPWNLRCNRDARRY

SEQ ID NO: 850545 - protein, 119 aa, Homo sapiens
MADGLFRRRPWGLEQIRPDPESEGLFDKPPPEDPPAARGPRSASAAGKKAGRRAGGRAQGGRAGQPPKAASRPPPKKEAPPLDEGCYLDHFPHLSIFIYAAIAFSITSCIFTYIHLQLA

SEQ ID NO: 850546 - protein, 1473 aa, Homo sapiens
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGLDQTTLSDEMRQELRALEQEKPQLLIFSRRKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKAIDDLEMKFQFVRIHKPPPLTPLYMGCRYTVSGSGSGMLEILPKELELCYRSPGEDQLFSEFYVGHLGSGIRLQVKDKKDETLVWEALVKPGDLMPATTLIPPARIAVPSPLDAPQLLHFVDQYREQLIARVTSVEVVLDKLHGQVLSQEQYERVLAENTRPSQMRKLFSLSQSWDRKCKDGLYQALKETHPHLIMELWEKGSKKGLLPLSS

SEQ ID NO: 850547 - protein, 1443 aa, Homo sapiens
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKAIDDLEMKFQFVRIHKPPPLTPLYMGCRYTVSGSGSGMLEILPKELELCYRSPGEDQLFSEFYVGHLGSGIRLQVKDKKDETLVWEALVKPGDLMPATTLIPPARIAVPSPLDAPQLLHFVDQYREQLIARVTSVEVVLDKLHGQVLSQEQYERVLAENTRPSQMRKLFSLSQSWDRKCKDGLYQALKETHPHLIMELWEKGSKKGLLPLSS

SEQ ID NO: 850548 - protein, 1371 aa, Homo sapiens
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGLDQTTLSDEMRQELRALEQEKPQLLIFSRRKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKAIDDLEMKFQFVRIHKPPPLTPLYMGCRYTVSGSGSGMLEILPKELELCYRSPGEDQLFSEFYVGHLGSGIRLQVKDKKDETLVWEALVKPGRNTSQPWNLRCNRDARRY

SEQ ID NO: 850549 - protein, 1371 aa, Homo sapiens; identical to SEQ ID NO: 850548

SEQ ID NO: 850550 - protein, 83 aa, Homo sapiens
VLRRLEDPLRRIWYPEELSHQETTSWKCPGLAGPVAADPAGTQAQSWRTPEDETLGALAGVHGRAVLGDSRMASFWPGSLLEL

SEQ ID NO: 850551 - protein, 31 aa, Homo sapiens
MTWAGVYLSCRLVSCGLTSDCCQDLASVLSA

SEQ ID NO: 850552 - protein, 1429 aa, Homo sapiens; identical to SEQ ID NO: 850541

SEQ ID NO: 850553 - protein, 1371 aa, Homo sapiens; identical to SEQ ID NO: 850548

SEQ ID NO: 850554 - protein, 300 aa, Homo sapiens
MTSGAPRGLWLLRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKAIDDLEMKFQFVRIHKPPPLTPLYMGCRYTVSGSGSGMLEILPKELELCYRSPGEDQLFSEFYVGHLGSGIRLQVKDKKDETLVWEALVKPGDLMPATTLIPPARIGRNTSQPWNLRCNRDARRY

SEQ ID NO: 850555 - protein, 1473 aa, Homo sapiens; identical to SEQ ID NO: 850546

SEQ ID NO: 850556 - protein, 1371 aa, Homo sapiens; identical to SEQ ID NO: 850548

SEQ ID NO: 850557 - protein, 1399 aa, Homo sapiens
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKELELCYRSPGEDQLFSEFYVGHLGSGIRLQVKDKKDETLVWEALVKPGDLMPATTLIPPARIAVPSPLDAPQLLHFVDQYREQLIARVTSVEVVLDKLHGQVLSQEQYERVLAENTRPSQMRKLFSLSQSWDRKCKDGLYQALKETHPHLIMELWEKGSKKGLLPLSS

SEQ ID NO: 850558 - protein, 1371 aa, Homo sapiens; identical to SEQ ID NO: 850548

SEQ ID NO: 850559 - protein, 118 aa, Homo sapiens [sequence omitted]

SEQ ID NO: 850560 - protein, 1013 aa, Homo sapiens
GSPWRGMAPRRLLLVGEGNFSFAAALSETLDQSTQLTATCLQRPAELARDPLAWENLQCLRERGIDVRFGVDCTQLADVFELHEREFDQIYFNFPHCGRKAGVAKNRELLAKFFQSCADVLAEEGEVHVALCRGQGGTPADKPQREWHNSWQVVAMAALGGLILSDVYPFSCKAVAGYKCTGYRSQDKSFHVEGALNHIFTRSLPFEGSQPRIFRIKLGNQWFSFPEPEALVGKLNRGFLEAPSCHPIKTINEKLIAELGKVFPLKRLKCSYPLLPQEGTSVLPFWNCDFLSAAFWISLHEDNSNSESLTGGTSQDVEDFLVSFSELSLLKNPGRDGKEEACEGTCGQAKICLRPSLLVHVQDVIEVPDFLSGYAMASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFYKAVCKKFGLHVSRMMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVCIMSLLLMDLIFMVQNPGISDLINGFLNFNVAFALALLVLPLTSLMEYLLQRFHVQNLGHPYWLTLAPMYIWFIIFFIQPHKEERFLFPVYPLICLCGAVALSALQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRLNLLPRLGSTPGLKQSSHFSLSKYWDYRPEPTVPGHNSLLELGSSKVLRDSCPFCQIRYAAVIHILN

SEQ ID NO: 850561 - protein, 681 aa, Homo sapiens
GSPWRGMAPRRLLLVGEGNFSFAAALSETLDQSTQLTATCLQRPAELARDPLAWENLQCLRERGIDVRFGVDCTQLADVFELHEREFDQIYFNFPHCGRKAGVAKNRELLAKFFQSCADVLAEEGEVHVALCRGQGGTPADKPQREWHNSWQVVAMAALGGLILSDVYPFSCKAVAGYKCTGYRSQDKSFHVEGALNHIFTRSLPFEGSQPRIFRIKLGNQWFSFPEPEALVGKLNRGFLEAPSCHPIKTINEKLIAELGKVFPLKRLKCSYPLLPQEGTSVLPFWNCDFLSAAFWISLHEDNSNSESLTGGTSQDVEDFLVSFSELSLLKNPGRDGKEEACEGTCGQAKICLRPSLLVHVQDVIEVPDFLSGYAMASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFYKAVCKKFGLHVSRMMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVCIMSLLLMDLIFMVQNPGISI

SEQ ID NO: 850562 - protein, 620 aa, Homo sapiens
MNKAIKSNDLVEEKKEKENDSFVAFKLSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFYKAVCKKFGLHVSRMMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVCIMSLLLMDLIFMVQNPGISDLINGFLNFNVAFALALLVLPLTSLMEYLLQRFHVQNLGHPYWLTLAPMYIWFIIFFIQPHKEERFLFPVYPLICLCGAVALSALQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRLNLLPRLGSTPGLKQSSHFSLSKYWDYRPEPTVPGHNSLLELGSSKVLRDSCPFCQIRYAAVIHILN

SEQ ID NO: 850563 - protein, 234 aa, Homo sapiens
GSPWRGMAPRRLLLVGEGNFSFAAALSETLDQSTQLTATCLQRPAELARDPLAWENLQCLRERGIDVRFGVDCTQLADVFELHEREFDQIYFNFPHCGRKAGVAKNRELLAKFFQSCADVLAEEGEVHVALCRGQGGTPADKPQREWHNSWQVVAMAALGGLILSDVYPFSCKAVAGYKCTGYRSQDKSFHVEGALNHIFTRSLPFEGSQPRIFRIKLGNQWFSFPEPEALVGK

SEQ ID NO: 850564 - protein, 129 aa, Homo sapiens
VPDFLSGSLHILSGPVFQKCHILPFTMPAFHETLFILGVNQNLKDGCLQSLLDHLKGILDSLLTQTLPESSKLSSLVKFVLQSNGKDYMIRVKTHNFSPDCTEDLIIGSVITSATSVIHKDQCFVFVSM

SEQ ID NO: 850565 - protein, 630 aa, Homo sapiens
GSPWRGMAPRRLLLVGEGNFSFAAALSETLDQSTQLTATCLQRPAELARDPLAWENLQCLRERGIDVRFGVDCTQLADVFELHEREFDQIYFNFPHCGRKAGVAKNRELLAKFFQSCADVLAEEGEVHVALCRGQGGTPADKPQREWHNSWQVVAMAALGGLILSDVYPFSCKAVAGYKCTGYRSQDKSFHVEGALNHIFTRSLPFEGSQPRIFRIKLGNQWFSFPEPEALVGKLNRGFLEAPSCHPIKTINEKLIAELGKVFPLKRLKCSYPLLPQEGTSVLPFWNCDFLSAAFWISLHEDNSNSESLTGGTSQDVEDFLVSFSELSLLKNPGRDGKEEACEGTCGQAKICLRPSLLVHVQDVIEVPDFLSGSLHILSGPVFQKCHILPFTMPAFHETLFILGVNQNLKDGCLQSLLDHLKGILDSLLTQTLPESSKLSSLVKFVLQSNGKDYMIRVKTHNFSPDCTEDLIIGSVITSATSVIHKDQCFVFVSMNLDLLAMLVWCISDWRMLWTFDNRFLKNFVPGKIEPFKSHSLYPPCYVHDVSFWIDQKKGFDELEFHTVARAVSQDTIISIQFLSRFQHPKTQQVSLCYRLTYQTCDKALTQQQVASMQSQFRKEIQQHLYVIPR

SEQ ID NO: 850566 - protein, 638 aa, Homo sapiens
MASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFYKAVCKKFGLHVSRMMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVCIMSLLLMDLIFMVQNPGISDLINGFLNFNVAFALALLVLPLTSLMEYLLQRFHVQNLGHPYWLTLAPMYIWFIIFFIQPHKEERFLFPVYPLICLCGAVALSALQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRLNLLPRLGSTPGLKQSSHFSLSKYWDYRPEPTVPGHNSLLELGSSKVLRDSCPFCQIRYAAVIHILN

SEQ ID NO: 850567 - protein, 745 aa, Homo sapiens
GSPWRGMAPRRLLLVGEGNFSFAAALSETLDQSTQLTATCLQRPAELARDPLAWENLQCLRERGIDVRFGVDCTQLADVFELHEREFDQIYFNFPHCGRKAGVAKNRELLAKFFQSCADVLAEEGEVHVALCRGQGGTPADKPQREWHNSWQVVAMAALGGLILSDVYPFSCKAVAGYKCTGYRSQDKSFHVEGALNHIFTRSLPFEGSQPRIFRIKLGNQWFSFPEPEALVGKLNRGFLEAPSCHPIKTINEKLIAELGKVFPLKRLKCSYPLLPQEGTSVLPFWNCDFLSAAFWISLHEDNSNSESLTGGTSQDVEDFLVSFSELSLLKNPGRDGKEEACEGTCGQAKICLRPSLLVHVQDVIEVPDFLSGYAMASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFYKAVCKKFGLHVSRMMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVCIMSLLLMDLIFMAPEPWFPFNSRDSEFHGALAWAPCLTRVSLKPGGFVEFGPRGSGRSFGKFAQRGRHKMGACKKCPKQVKVLR

SEQ ID NO: 850568 - protein, 630 aa, Homo sapiens; identical to SEQ ID NO: 850565

SEQ ID NO: 850569 - protein, 103 aa, Homo sapiens
NTAISWGDQAIDSLCNMAVFVQHYKRLLSLSNPSVCKKLWELFCILTTTNSGMYGLLCGRVLCQDCKVPPHVKASKQTSHIFPLDIMIECVKNSLVSSSPFLF

SEQ ID NO: 850570 - protein, 74 aa, Homo sapiens
YLCDALEIPRLYCKNGGFFLRIHPDGRVDGVREKSDPHIKLQLQAEERGVVSIKGVCANRYLAMKEGGSSRVIH

SEQ ID NO: 850571 - protein, 155 aa, Homo sapiens [sequence omitted]

SEQ ID NO: 850572 - protein, 104 aa, Homo sapiens
MGVVFSVFARSLRSIHSHLKHSSWQKFMVNEYGFRRQMIYISDFPKAPGFVCCCRILRTDLNSDFIPVSSKTSRTAVSLRKKRDVQINNNYTFRNCIIKDFQLK

SEQ ID NO: 850573 - protein, 123 aa, Homo sapiens
MGVVFSVFARSLRSIHSHLKHSSWQKFMVNEYGFRRQMIYISDFPKAPGFVCCCRILRTDLNSDFIPVSSKTSRTAVSPISSSGSDRPPGNFHIFFNCSIKSENKVNITFTNTHICRFHKIHL

SEQ ID NO: 850574 - protein, 108 aa, Homo sapiens
MGVVFSVFARSLRSIHSHLKHSSWQKFMVNEYGFRRQMIYISDFPKAPGFVCCCRILRTDLNSDFIPVSSKTSRTAVSPISSSGSDRPPGNFHIFFNGPVVNKKVLAR

SEQ ID NO: 850575 - protein, 602 aa, Homo sapiens
MFKCPFLFIMLGKIIMGKYMFVIKFIIKDSSTSLKFDITSPNLFKCPFLFFMFENKLWGSYLALSTTNQKFGMELMIYAVSMSWKHRMGVVSKSALLSSHHRQLTENQHCLSSFDQFNLNHYTDLKIEWANKCFCLQSMRETLPPQDGYFFPKDFKMNEIFNQDSVLYSVVFFIILIYCKPNWNNICCFIGLKNIGKTKRFCFFFADEEICLNMLYCFVLLQDNNEMEFIFVISILLYLIIELDGNKIYMGNNLQNVGFPGVSSDSSALMISDKAQLLYSSLANAADTLPASGEYDFLRRQFVNFNLVDTFILLGYYFIQKPSGLHSIFYMTLLIFKKHYWITILHLPSIMKERRSSNKCVSQLTRVYCLSQYKCLTVCDGSIPKVHCMFSKIQSLNNFSEFLDDSASSLRISFVLFELEMPSYRHSLSDLYCQFSFLSCFQGFMNFQAKLEFILSLGSMANANGSFFLLNSNMTEAYMISGWVSCCDNHKHFFFFERKKGSELFNHLDFKKDSGVYLGLKLYIFGLEMCFSSITSTSKYQLKFRGPIRVHMKKINYLKRQDAGERKPCKPADCFLPNIDWVRLQNISLISSHALLSRGTSG

SEQ ID NO: 850576 - protein, 95 aa, Homo sapiens
MAAGSITTLPALPEDGGSGAFPPGHFKDPKRLYCKNGGFFLRIHPDGRVDGVREKSDPHIKLQLQAEERGVVSIKGVCANRYLAMKEGGSSRVIH

SEQ ID NO: 850577 - protein, 140 aa, Homo sapiens
MDSRIPYDDYPVVFLPAYENPPAWIPPHERVHHPDYNNELTQFLPRTITLKKPPGAQLGFNIRGGKASQLGIFISKVIPDSDAHRAGLQEGDQVLAVNDVDFQDIEHSKAVEILKTAREISMRVRFFPYNYHRQKERTVH

SEQ ID NO: 850578 - protein, 162 aa, Homo sapiens
RGRIGRWVRLRSLWTAHWALPEMDSRIPYDDYPVVFLPAYENPPAWIPPHERVHHPDYNNELTQFLPRTITLKKPPGAQLGFNIRGGKASQLGIFISKVIPDSDAHRAGLQEGDQVLAVNDVDFQDIEHSKAVEILKTAREISMRVRFFPYNYHRQKERTVH

SEQ ID NO: 850579 - protein, 140 aa, Homo sapiens; identical to SEQ ID NO: 850577

SEQ ID NO: 850580 - protein, 172 aa, Homo sapiens
MGWSCCLKLAGLLSLLNHFLSVLIHSSRALPEMDSRIPYDDYPVVFLPAYENPPAWIPPHERVHHPDYNNELTQFLPRTITLKKPPGAQLGFNIRGGKASQLGIFISKVIPDSDAHRAGLQEGDQVLAVNDVDFQDIEHSKAVEILKTAREISMRVRFFPYNYHRQKERTVH

SEQ ID NO: 850581 - protein, 145 aa, Homo sapiens [sequence omitted]

SEQ ID NO: 850582 - protein, 140 aa, Homo sapiens; identical to SEQ ID NO: 850577

SEQ ID NO: 850583 - protein, 162 aa, Homo sapiens; identical to SEQ ID NO: 850578

SEQ ID NO: 850584 - protein, 140 aa, Homo sapiens; identical to SEQ ID NO: 850577

SEQ ID NO: 850585 - protein, 140 aa, Homo sapiens; identical to SEQ ID NO: 850577

SEQ ID NO: 850586 - protein, 174 aa, Homo sapiens
MDSRIPYDDYPVVFLPAYENPPAWIPPHERVHHPDYNNELTQFLPRTITLKKPPGAQLGFNIRGGKASQLGIFISKVIPDSDAHRAGLQEGDQVLAVNDVDFQDIEHSKAVEILKTAREISMRVRFFPYICHDMLTRLQGSHFCFQPLPGIVSWEDGETANQLHYPNHIALLVP

SEQ ID NO: 850587 - protein, 259 aa, Homo sapiens
APARREPRDRCACAVRVCETDLDGAELRLGFLLMVRVLATPRCERGRECSRRRRDLKASVWQKDQLVTQPHWQENGPTFSSTPYRYQACRFGQVPDQPAGLRLFTVQIPHKRRAPELYRAPFPLYALQVDPSTGLLIAAGGGGAAKTGIKNGVHFLQLELINGRLSASLLHSHDTETRATMNLALAGDILAAGQDAHCQLLRFQAHQQQGNKAEKAGSKEQGPRQRKGAAPAEKKCGAETQHEGLELRVENLQGGADRL

SEQ ID NO: 850588 - protein, 151 aa, Homo sapiens
MGRRRAPELYRAPFPLYALQVDPSTGLLIAAGGGGAAKTGIKNGVHFLQLELINGRLSASLLHSHDTETRATMNLALAGDILAAGQDAHCQLLRFQAHQQQGNKAEKAGSKEQGPRQRKGAAPAEKKCGAETQHEGLELRVENLQGGADRL

SEQ ID NO: 850589 - protein, 151 aa, Homo sapiens; identical to SEQ ID NO: 850588

SEQ ID NO: 850590 - protein, 151 aa, Homo sapiens; identical to SEQ ID NO: 850588

SEQ ID NO: 850591 - protein, 109 aa, Homo sapiens
MGRRRAPELYRAPFPLYALQVDPSTGLLIAAGGGGAAKTGIKNGVVRAQGHWGWVLLRAGGDSRVAGGSRGGPHSSFGPCPLLLGRPACLTPRGEFQSRTQRAEERLLR

SEQ ID NO: 850592 - protein, 151 aa, Homo sapiens; identical to SEQ ID NO: 850588

SEQ ID NO: 850593 - protein, 151 aa, Homo sapiens; identical to SEQ ID NO: 850588

SEQ ID NO: 850594 - protein, 151 aa, Homo sapiens; identical to SEQ ID NO: 850588

SEQ ID NO: 850595 - protein, 109 aa, Homo sapiens; identical to SEQ ID NO: 850591

SEQ ID NO: 850596 - protein, 151 aa, Homo sapiens; identical to SEQ ID NO: 850588

SEQ ID NO: 850597 - protein, 259 aa, Homo sapiens; identical to SEQ ID NO: 850587

SEQ ID NO: 850598 - protein, 109 aa, Homo sapiens; identical to SEQ ID NO: 850591

SEQ ID NO: 850599 - protein, 151 aa, Homo sapiens; identical to SEQ ID NO: 850588

SEQ ID NO: 850600 - protein, 965 aa, Homo sapiens
MASSHSSSPVPQGSSSDVFFKIEVDPSKHIRPVPSLPDVCPKEPTVTDQHRWTVYHSKVNLPAALNDPRLAKRESDFFTKTWGLDFVDTEVIPSFYLPQISKEHFTVYQQEISQREKIHERCKNICPPKDTFERTLLHTHDKSRTDLEQVPKIFMKPDFALDDSLTFNSVLPWSHFNTAGGKGNRDAASSKLLQEKLSHYLDIVEVNIAHQISLRSEAFFHAMTSQHELQDYLRKTSQAVKMLRDKIAQIDKVMCEGSLHILRLALTRNNCVKVYNKLKLMATVHQTQPTVQVLLSTSEFVGALDLIATTQEVLQQELQGIHSFRHLGSQLCELEKLIDKMMIAEFSTYSHSDLNRPLEDDCQVLEEERLISLVFGLLKQRKLNFLEIYGEKMVITAKNIIKQCVINKVSQTEEIDTDVVVKLADQMRMLNFPQWFDLLKDIFSKFTIFLQRVKATLNIIHSVVLSVLDKNQRTRELEEISQQKNAAKDNSLDTEVAYLIHEGMFISDAFGEGELTPIAVDTTSQRNASPNSEPCSSDSVSEPECTTDSSSSKEHTSSSAIPGGVDIMVSEDMKLTDSELGKLANNIQELLYSASDICHDRAVKFLMSRAKDGFLEKLNSMEFITLSRLMETFILDTEQICGRKSTSLLGALQSQAIKFVNRFHEERKTKLSLLLDNERWKQADVPAEFQDLVDSLSDGKIALPEKKSGATEERKPAEVLIVEGQQYAVVGTVLLLIRIILEYCQCVDNIPSVTTDMLTRLSDLLKYFNSRSCQLVLGAGALQVVGLKTITTKNLALSSRCLQLIVHYIPVIRAHFEARLPPKQYSMLRHFDHITKDYHDHIAEISAKLVAIMDSLFDKLLSKYEVKAPVPSACFRNICKQMTKMHEAIFDLLPEEQTQMLFLRINASYKLHLKKQLSHLNVINDGGPQNGLVTADVAFYTGNLQALKGLKDLDLNMAEIWEQKR

SEQ ID NO: 850601 - protein, 965 aa, Homo sapiens; identical to SEQ ID NO: 850600

SEQ ID NO: 850602 - protein, 999 aa, Homo sapiens
MASSHSSSPVPQGSSSDVFFKIEVDPSKHIRPVPSLPDVCPKEPTVTDQHRWTVYHSKVNLPAALNDPRLAKRESDFFTKTWGLDFVDTEVIPSFYLPQISKEHFTVYQQEISQREKIHERCKNICPPKDTFERTLLHTHDKSRTDLEQVPKIFMKPDFALDDSLTFNSVLPWSHFNTAGGKGNRDAASSKLLQEKLSHYLDIVEVNIAHQISLRSEAFFHAMTSQHELQDYLRKTSQAVKMLRDKIAQIDKVMCEGSLHILRLALTRNNCVKVYNKLKLMATVHQTQPTVQVLLSTSEFVGALDLIATTQEVLQQELQGIHSFRHLGSQLCELEKLIDKMMIAEFSTYSHSDLNRPLEDDCQVLEEERLISLVFGLLKQRKLNFLEIYGEKMVITAKNIIKQCVINKVSQTEEIDTDVVVKLADQMRMLNFPQWFDLLKDIFSKFTIFLQRVKATLNIIHSVVLSVLDKNQRTRELEEISQQKNAAKDNSLDTEVAYLIHEGMFISDAFGEGELTPIAVDTTSQRNASPNSEPCSSDSVSEPECTTDSSSSKEHTSSSAIPGGVDIMVSEDMKLTDSELGKLANNIQELLYSASDICHDRAVKFLMSRAKDGFLEKLNSMEFITLSRLMETFILDTEQICGRKSTSLLGALQSQAIKFVNRFHEERKTKLSLLLDNERWKQADVPAEFQDLVDSLSDGKIALPEKKSGATEERKPAEVLIVEGQQYAVVGTVLLLIRIILEYCQCVDNIPSVTTDMLTRLSDLLKVLNMTEATSGQKTWTGFKCAWKEFTELYKIHLTKYFNSRSCQLVLGAGALQVVGLKTITTKNLALSSRCLQLIVHYIPVIRAHFEARLPPKQYSMLRHFDHITKDYHDHIAEISAKLVAIMDSLFDKLLSKYEVKAPVPSACFRNICKQMTKMHEAIFDLLPEEQTQMLFLRINASYKLHLKKQLSHLNVINDGGPQNGLVTADVAFYTGNLQALKGLKDLDLNMAEIWEQKR

SEQ ID NO: 850603 - protein, 977 aa, Homo sapiens
MASSHSSSPVPQGSSSDVFFKIEVDPSKHIRPVPSLPDVCPKEPTGDSHSLYVAPSLVTDQHRWTVYHSKVNLPAALNDPRLAKRESDFFTKTWGLDFVDTEVIPSFYLPQISKEHFTVYQQEISQREKIHERCKNICPPKDTFERTLLHTHDKSRTDLEQVPKIFMKPDFALDDSLTFNSVLPWSHFNTAGGKGNRDAASSKLLQEKLSHYLDIVEVNIAHQISLRSEAFFHAMTSQHELQDYLRKTSQAVKMLRDKIAQIDKVMCEGSLHILRLALTRNNCVKVYNKLKLMATVHQTQPTVQVLLSTSEFVGALDLIATTQEVLQQELQGIHSFRHLGSQLCELEKLIDKMMIAEFSTYSHSDLNRPLEDDCQVLEEERLISLVFGLLKQRKLNFLEIYGEKMVITAKNIIKQCVINKVSQTEEIDTDVVVKLADQMRMLNFPQWFDLLKDIFSKFTIFLQRVKATLNIIHSVVLSVLDKNQRTRELEEISQQKNAAKDNSLDTEVAYLIHEGMFISDAFGEGELTPIAVDTTSQRNASPNSEPCSSDSVSEPECTTDSSSSKEHTSSSAIPGGVDIMVSEDMKLTDSELGKLANNIQELLYSASDICHDRAVKFLMSRAKDGFLEKLNSMEFITLSRLMETFILDTEQICGRKSTSLLGALQSQAIKFVNRFHEERKTKLSLLLDNERWKQADVPAEFQDLVDSLSDGKIALPEKKSGATEERKPAEVLIVEGQQYAVVGTVLLLIRIILEYCQCVDNIPSVTTDMLTRLSDLLKYFNSRSCQLVLGAGALQVVGLKTITTKNLALSSRCLQLIVHYIPVIRAHFEARLPPKQYSMLRHFDHITKDYHDHIAEISAKLVAIMDSLFDKLLSKYEVKAPVPSACFRNICKQMTKMHEAIFDLLPEEQTQMLFLRINASYKLHLKKQLSHLNVINDGGPQNGLVTADVAFYTGNLQALKGLKDLDLNMAEIWEQKR

SEQ ID NO: 850604 - protein, 462 aa, Homo sapiens
MFISDAFGEGELTPIAVDTTSQRNASPNSEPCSSDSVSEPECTTDSSSSKEHTSSSAIPGGVDIMVSEDMKLTDSELGKLANNIQELLYSASDICHDRAVKFLMSRAKDGFLEKLNSMEFITLSRLMETFILDTEQICGRKSTSLLGALQSQAIKFVNRFHEERKTKLSLLLDNERWKQADVPAEFQDLVDSLSDGKIALPEKKSGATEERKPAEVLIVEGQQYAVVGTVLLLIRIILEYCQCVDNIPSVTTDMLTRLSDLLKYFNSRSCQLVLGAGALQVVGLKTITTKNLALSSRCLQLIVHYIPVIRAHFEARLPPKQYSMLRHFDHITKDYHDHIAEISAKLVAIMDSLFDKLLSKYEVKAPVPSACFRNICKQMTKMHEAIFDLLPEEQTQMLFLRINASYKLHLKKQLSHLNVINDGGPQNGLVTADVAFYTGNLQALKGLKDLDLNMAEIWEQKR

SEQ ID NO: 850605 - protein, 999 aa, Homo sapiens; identical to SEQ ID NO: 850602

SEQ ID NO: 850606 - protein, 407 aa, Homo sapiens
PCGRGAPAGGAGRATDKEAGPAAGLEAPRSGGSGAAWGPHLWAAAAAETHGQAKAKSGWLKPYYFIELMESRKDITNQEELWKMKPRRNLEEDDYLHKDTGETSMLKRPVLLHLHQTAHADEFDCPSELQHTQELFPQWHLPIKIAAIIASLTFLYTLLREVIHPLATSHQQYFYKIPILVINKVLPMVSITLLALVYLPGVIAAIVQLHNGTKYKKFPHWLDKWMLTRKQFGLLSFFFAVLHAIYSLSYPMRRSYRYKLLNWAYQQVQQNKEDAWIEHDVWRMEIYVSLGIVGLAILALLAVTSIPSVSDSLTWREFHYIQSKLGIVSLLLGTIHALIFAWNKWIDIKQFVWYTPPTFMIAVFLPIVVLIFKSILFLPCLRKKILKIRHGWEDVTKINKTEICSQL

SEQ ID NO: 850607 - protein, 323 aa, Homo sapiens
AAATTTTKFGGRHKDTGETSMLKRPVLLHLHQTAHADEFDCPSELQHTQELFPQWHLPIKIAAIIASLTFLYTLLREVIHPLATSHQQYFYKIPILVINKVLPMVSITLLALVYLPGVIAAIVQLHNGTKYKKFPHWLDKWMLTRKQFGLLSFFFAVLHAIYSLSYPMRRSYRYKLLNWAYQQVQQNKEDAWIEHDVWRMEIYVSLGIVGLAILALLAVTSIPSVSDSLTWREFHYIQSKLGIVSLLLGTIHALIFAWNKWIDIKQFVWYTPPTFMIAVFLPIVVLIFKSILFLPCLRKKILKIRHGWEDVTKINKTEICSQL

SEQ ID NO: 850608 - protein, 289 aa, Homo sapiens
ARFRRRRAFASLGWSSGRVSRPEHVDAHPPLSLMEVVTFGDVAVHFSREEWQCLDPGQRALYREVMLENHSSVAGLAGFLVFKPELISRLEQGEEPWVLDLQGAEGTEAPRTSKTDSTIRTENEQACEDMDILKSESYGTVVRISPQDFPQNPGFGDVSDSEVWLDSHLGSPGLKVTGFTFQNNCLNEETVVPKTFTKDAPQGCKELGSSGLDCQPLESQGESAEGMSQRCEECGKGIRATSDIALHWEINTQKISRCQECQKKNLDWLCQGGKPFPNLTLAHWEEEPR

SEQ ID NO: 850609 - protein, 719 aa, Homo sapiens
ARFRRRRAFASLGWSSGRVSRPEHVDAHPPLSLMEVVTFGDVAVHFSREEWQCLDPGQRALYREVMLENHSSVAGLAGFLVFKPELISRLEQGEEPWVLDLQGAEGTEAPRTSKTDSTIRTENEQACEDMDILKSESYGTVVRISPQDFPQNPGFGDVSDSEVWLDSHLGSPGLKVTGFTFQNNCLNEETVVPKTFTKDAPQGCKELGSSGLDCQPLESQGESAEGMSQRCEECGKGIRATSDIALHWEINTQKISRCQECQKKLSDCLQGKHTNNCHGEKPYECAECGKVFRLCSQLNQHQRIHTGEKPFKCTECGKAFRLSSKLIQHQRIHTGEKPYRCEECGKAFGQSSSLIHHQRIHTGERPYGCRECGKAFSQQSQLVRHQRTHTGERPYPCKECGKAFSQSSTLAQHQRMHTGEKAQILKASDSPSLVAHQRIHAVEKPFKCDECGKAFRWISRLSQHQLIHTGEKPYKCNKCTKAFGCSSRLIRHQRTHTGEKPFKCDECGKGFVQGSHLIQHQRIHTGEKPYVCNDCGKAFSQSSSLIYHQRIHKGEKPYECLQCGKAFSMSTQLTIHQRVHTGERPYKCNECGKAFSQNSTLFQHQIIHAGVKPYECSECGKAFSRSSYLIEHQRIHTRAQWFYEYGNALEGSTFVSRKKVNTIKKLHQCEDCEKIFRWRSHLIIHQRIHTGEKPYKCNDCGKAFNRSSRLTQHQKIHMG

SEQ ID NO: 850610 - protein, 707 aa, Homo sapiens
MRQRQKGAGTQGFLGCWCVSFQEVVTFGDVAVHFSREEWQCLDPGQRALYREVMLENHSSVAGLAGFLVFKPELISRLEQGEEPWVLDLQGAEGTEAPRTSKTDSTIRTENEQACEDMDILKSESYGTVVRISPQDFPQNPGFGDVSDSEVWLDSHLGSPGLKVTGFTFQNNCLNEETVVPKTFTKDAPQGCKELGSSGLDCQPLESQGESAEGMSQRCEECGKGIRATSDIALHWEINTQKISRCQECQKKLSDCLQGKHTNNCHGEKPYECAECGKVFRLCSQLNQHQRIHTGEKPFKCTECGKAFRLSSKLIQHQRIHTGEKPYRCEECGKAFGQSSSLIHHQRIHTGERPYGCRECGKAFSQQSQLVRHQRTHTGERPYPCKECGKAFSQSSTLAQHQRMHTGEKAQILKASDSPSLVAHQRIHAVEKPFKCDECGKAFRWISRLSQHQLIHTGEKPYKCNKCTKAFGCSSRLIRHQRTHTGEKPFKCDECGKGFVQGSHLIQHQRIHTGEKPYVCNDCGKAFSQSSSLIYHQRIHKGEKPYECLQCGKAFSMSTQLTIHQRVHTGERPYKCNECGKAFSQNSTLFQHQIIHAGVKPYECSECGKAFSRSSYLIEHQRIHTRAQWFYEYGNALEGSTFVSRKKVNTIKKLHQCEDCEKIFRWRSHLIIHQRIHTGEKPYKCNDCGKAFNRSSRLTQHQKIHMG

SEQ ID NO: 850611 - protein, 564 aa, Homo sapiens
ARFRRRRAFASLGWSSGRVSRPEHVDAHPPLSLMEVVTFGDVAVHFSREEWQCLDPGQRALYREVMLENHSSVAGLAGFLVFKPELISRLEQGEEPWVLDLQGAEGTEAPRTSKTGEHTNNCHGEKPYECAECGKVFRLCSQLNQHQRIHTGEKPFKCTECGKAFRLSSKLIQHQRIHTGEKPYRCEECGKAFGQSSSLIHHQRIHTGERPYGCRECGKAFSQQSQLVRHQRTHTGERPYPCKECGKAFSQSSTLAQHQRMHTGEKAQILKASDSPSLVAHQRIHAVEKPFKCDECGKAFRWISRLSQHQLIHTGEKPYKCNKCTKAFGCSSRLIRHQRTHTGEKPFKCDECGKGFVQGSHLIQHQRIHTGEKPYVCNDCGKAFSQSSSLIYHQRIHKGEKPYECLQCGKAFSMSTQLTIHQRVHTGERPYKCNECGKAFSQNSTLFQHQIIHAGVKPYECSECGKAFSRSSYLIEHQRIHTRAQWFYEYGNALEGSTFVSRKKVNTIKKLHQCEDCEKIFRWRSHLIIHQRIHTGEKPYKCNDCGKAFNRSSRLTQHQKIHMG

SEQ ID NO: 850612 - protein, 169 aa, Homo sapiens
MRQRQKGAGTQGFLGCWCVSFQEVVTFGDVAVHFSREEWQCLDPGQRALYREVMLENHSSVAGLAGFLVFKPELISRLEQGEEPWVLDLQGAEGTEAPRTSKTGFLGRPTMGQEPRHPHAPPATPVPGLPKHCSQRLTLPPPGLSSSPLGHFLVHDQDRRRGTSAIWMV

SEQ ID NO: 850613 - protein, 128 aa, Homo sapiens
ARFRRRRAFASLGWSSGRVSRPEHVDAHPPLSLMEVVTFGDVAVHFSREEWQCLDPGQRALYREVMLENHSSVAGLAGFLVFKPELISRLEQGEEPWVLDLQGAEGTEAPRTSKTVLVIQGEPGTPDW

SEQ ID NO: 850614 - protein, 686 aa, Homo sapiens
MEVVTFGDVAVHFSREEWQCLDPGQRALYREVMLENHSSVAGLAGFLVFKPELISRLEQGEEPWVLDLQGAEGTEAPRTSKTDSTIRTENEQACEDMDILKSESYGTVVRISPQDFPQNPGFGDVSDSEVWLDSHLGSPGLKVTGFTFQNNCLNEETVVPKTFTKDAPQGCKELGSSGLDCQPLESQGESAEGMSQRCEECGKGIRATSDIALHWEINTQKISRCQECQKKLSDCLQGKHTNNCHGEKPYECAECGKVFRLCSQLNQHQRIHTGEKPFKCTECGKAFRLSSKLIQHQRIHTGEKPYRCEECGKAFGQSSSLIHHQRIHTGERPYGCRECGKAFSQQSQLVRHQRTHTGERPYPCKECGKAFSQSSTLAQHQRMHTGEKAQILKASDSPSLVAHQRIHAVEKPFKCDECGKAFRWISRLSQHQLIHTGEKPYKCNKCTKAFGCSSRLIRHQRTHTGEKPFKCDECGKGFVQGSHLIQHQRIHTGEKPYVCNDCGKAFSQSSSLIYHQRIHKGEKPYECLQCGKAFSMSTQLTIHQRVHTGERPYKCNECGKAFSQNSTLFQHQIIHAGVKPYECSECGKAFSRSSYLIEHQRIHTRAQWFYEYGNALEGSTFVSRKKVNTIKKLHQCEDCEKIFRWRSHLIIHQRIHTGEKPYKCNDCGKAFNRSSRLTQHQKIHMG

SEQ ID NO: 850615 - protein, 74 aa, Homo sapiens
SSVPPCWHHWDSERKEESPTASCLPPPPSLTSVELPLALLLLPHPRSKSWTPFLGPYQLSPSRRAGCHPGFPAS

SEQ ID NO: 850616 - protein, 552 aa, Homo sapiens
MRQRQKGAGTQGFLGCWCVSFQEVVTFGDVAVHFSREEWQCLDPGQRALYREVMLENHSSVAGLAGFLVFKPELISRLEQGEEPWVLDLQGAEGTEAPRTSKTGEHTNNCHGEKPYECAECGKVFRLCSQLNQHQRIHTGEKPFKCTECGKAFRLSSKLIQHQRIHTGEKPYRCEECGKAFGQSSSLIHHQRIHTGERPYGCRECGKAFSQQSQLVRHQRTHTGERPYPCKECGKAFSQSSTLAQHQRMHTGEKAQILKASDSPSLVAHQRIHAVEKPFKCDECGKAFRWISRLSQHQLIHTGEKPYKCNKCTKAFGCSSRLIRHQRTHTGEKPFKCDECGKGFVQGSHLIQHQRIHTGEKPYVCNDCGKAFSQSSSLIYHQRIHKGEKPYECLQCGKAFSMSTQLTIHQRVHTGERPYKCNECGKAFSQNSTLFQHQIIHAGVKPYECSECGKAFSRSSYLIEHQRIHTRAQWFYEYGNALEGSTFVSRKKVNTIKKLHQCEDCEKIFRWRSHLIIHQRIHTGEKPYKCNDCGKAFNRSSRLTQHQKIHMG

SEQ ID NO: 850617 - protein, 661 aa, Homo sapiens
GPFPAASRVCEPRVVLREAGFLVFKPELISRLEQGEEPWVLDLQGAEGTEAPRTSKTDSTIRTENEQACEDMDILKSESYGTVVRISPQDFPQNPGFGDVSDSEVWLDSHLGSPGLKVTGFTFQNNCLNEETVVPKTFTKDAPQGCKELGSSGLDCQPLESQGESAEGMSQRCEECGKGIRATSDIALHWEINTQKISRCQECQKKLSDCLQGKHTNNCHGEKPYECAECGKVFRLCSQLNQHQRIHTGEKPFKCTECGKAFRLSSKLIQHQRIHTGEKPYRCEECGKAFGQSSSLIHHQRIHTGERPYGCRECGKAFSQQSQLVRHQRTHTGERPYPCKECGKAFSQSSTLAQHQRMHTGEKAQILKASDSPSLVAHQRIHAVEKPFKCDECGKAFRWISRLSQHQLIHTGEKPYKCNKCTKAFGCSSRLIRHQRTHTGEKPFKCDECGKGFVQGSHLIQHQRIHTGEKPYVCNDCGKAFSQSSSLIYHQRIHKGEKPYECLQCGKAFSMSTQLTIHQRVHTGERPYKCNECGKAFSQNSTLFQHQIIHAGVKPYECSECGKAFSRSSYLIEHQRIHTRAQWFYEYGNALEGSTFVSRKKVNTIKKLHQCEDCEKIFRWRSHLIIHQRIHTGEKPYKCNDCGKAFNRSSRLTQHQKIHMG

SEQ ID NO: 850618 - protein, 200 aa, Homo sapiens
MRQRQKGAGTQGFLGCWCVSFQEVVTFGDVAVHFSREEWQCLDPGQRALYREVMLENHSSVAGLAGFLVFKPELISRLEQGEEPWVLDLQGAEGTEAPRTSKTDSTIRTENEQACEDMDILKSESYGTVVRISPQDFPQNPGFGDVSDSEVWLDSHLGSPGLKVTGFTFQNNCLNEETVVPKTFTKDAPPLLTYWENSLC

SEQ ID NO: 850619 - protein, 517 aa, Homo sapiens
MFKKRNKLSSTEIKRFSRSLGGPWEAPEVGAGAGWLQRSAAGAGSGPWAAQEKQFPPALLSFFIYNPRFGPREGQEENKILFYHPNEVEKNEKIRNVGLCEAIVQFTRTFSPSKPAKSLHTQKNRQFFNEPEENFWMVMVVRNPIIEKQSKDGKPVIEYQEEELLDKVYSSVLRQCYSMYKLFNGTFLKAMEDGGVKLLKERLEKFFHRYLQTLHLQSCDLLDIFGGISFFPLDKMTYLKIQSFINRMEESLNIVKYTAFLYNDQLIWSGLEQDDMRILYKYLTTSLFPRHIEPELAGRDSPIRAEMPGNLQHYGRFLTGPLNLNDPDAKCRFPKIFVNTDDTYEELHLIVYKAMSAAVCFMIDASVHPTLDFCRRLDSIVGPQLTVLASDICEQFNINKRMSGSEKEPQFKFIYFNHMNLAEKSTVHMRKTPSVSLTSVHPDLMKILGDINSDFTRVDEDEEIIVKAMSDYWVVGKKSDRRELYVILNQKNANLIEVNEEVKKLCATQFNNIFFLD

SEQ ID NO: 850620 - protein, 517 aa, Homo sapiens; identical to SEQ ID NO: 850619

SEQ ID NO: 850621 - protein, 517 aa, Homo sapiens; identical to SEQ ID NO: 850619

SEQ ID NO: 850622 - protein, 457 aa, Homo sapiens
MFKKRNKLSSTEIKRFSRSLGGPWEAPEVGAGAGWLQRSAAGAGSGPWAAQEKQFPPALLSFFIYNPRFGPREGQEENKILFYHPNEVEKNEKIRNVGLCEAIVQFTRTFSPSKPAKSLHTQKNRQFFNEPEENFWMVMVVRNPIIEKQSKDGKPVIEYQEEELLDKVYSSVLRQCYSMYKLFNGTFLKAMEDGGVKLLKERLEKFFHRYLQTLHLQSCDLLDIFGGISFFPLDKMTYLKIQSFINRMEESLNIVKYTAFLYNDQLIWSGLEQDDMRILYKYLTTSLFPRHIEPELAGRDSPIRAEMPGNLQHYGRFLTGPLNLNDPDAKCRFPKIFVNTDDTYEELHLIVYKAMSAAVCFMIDASVHPTLDFCRRLDSIVGPQLTVLASDICEQFNINKRMSGSEKEPQFKFIYFNHMNLAEKSTVHMRKTPSVSLTSVHPDLMKILGDINSDFTR

SEQ ID NO: 850623 - protein, 268 aa, Homo sapiens
MFKKRNKLSSTEIKRFSRSLGGPWEAPEVGAGAGWLQRSAAGAGSGPWAAQEKQFPPALLSFFIYNPRFGPREGQEENKILFYHPNEVEKNEKIRNVGLCEAIVQFTRTFSPSKPAKSLHTQKNRQFFNEPEENFWMVMVVRNPIIEKQSKDGKPVIEYQEEELLDKVYSSVLRQCYSMYKLFNGTFLKAMEDGGVKLLKERLEKFFHRYLQTLHLQSCDLLDIFGGISFFPLDKMTYLKIQSFINRMEESLNIVKYTAFLYNDQLIW

SEQ ID NO: 850624 - protein, 457 aa, Homo sapiens; identical to SEQ ID NO: 850622

SEQ ID NO: 850625 - protein, 415 aa, Homo sapiens
MFKKRNKLSSTEIKRFSRSLGGPWEAPEVGAGAGWLQRSAAGAGSGPWAAQEKQFPPALLSFFIYNPRFGPREGQEENKILFYHPNEVEKNEKIRNVGLCEAIVQFTRTFSPSKPAKSLHTQKNRQFFNEPEENFWMVMVVRNPIIEKQSKDGKPVIEYQEEELLDKVYSSVLRQCYSMYKLFNGTFLKAMEDGGVKLLKERLEKFFHRYLQTLHLQSCDLLDIFGGISFFPLDKMTYLKIQSFINRMEESLNIVKYTAFLYNDQLIWSGLEQDDMRILYKYLTTSLFPRHIEPELAGRDSPIRAEMPGNLQHYGRFLTGPLNLNDPDAKCRFPKIFVNTDDTYEELHLIVYKAMSAAVCFMIDASVHPTLDFCRRLDSIVGPQLTVLASDICEQFNINKRMSGFVLCFRFTFRH

SEQ ID NO: 850626 - protein, 572 aa, Homo sapiens
PTPMGGAGATCCSRRPVRRRWLGGKMAAVSLRLGDLVWGKLGRYPPWPGKIVNPPKDLKKPRGKKCFFVKFFGTEDHAWIKVEQLKPYHAHKEEMIKINKGKRFQQAVDAVEEFLRRAKGKDQTSSHNSSDDKNRRNSSEERSRPNSGDEKRKLSLSEGKVKKNMGEGKKRVSSGSSERGSKSPLKRAQEQSPRKRGRPPKDEKDLTIPESSTVKGMMAGPMAAFKWQPTASEPVKDADPHFHHFLLSQTEKPAVCYQAITKKLKICEEETGSTSIQAADSTAVNGSITPTDKKIGFLGLGLMGSGIVSNLLKMGHTVTVWNRTAEKEGARLGRTPAEVVSTCDITFACVSDPKAAKDLVLGPSGVLQGIRPGKCYVDMSTVDADTVTELAQVIVSRGGRFLEAPVSGNQQLSNDGMLVILAAGDRGLYEDCSSCFQAMGKTSFFLGEVGNAAKMMLIVNMVQGSFMATIAEGLTLAQVTGQSQQTLLDILNQGQLASIFLDQKCQNILQGNFKPDFYLKYIQKDLRLAIALGDAVNHPTPMAAAANEVYKRAKALDQSDNDMSAVYRAYIH

SEQ ID NO: 850627 - protein, 167 aa, Homo sapiens
PTPMGGAGATCCSRRPVRRRWLGGKMAAVSLRLGDLVWGKLGRYPPWPGKIVNPPKDLKKPRGKKCFFVKFFGTEDHAWIKVEQLKPYHAHKEEMIKINKGKRFQQAVDAVEEFLRRAKGKDQVRDTMFTFYQCQTGDFCIATNRLNVTQTQTFVLLKCYWRKLLQF

SEQ ID NO: 850628 - protein, 617 aa, Homo sapiens
PTPMGGAGATCCSRRPVRRRWLGGKMAAVSLRLGDLVWGKLGRYPPWPGKIVNPPKDLKKPRGKKCFFVKFFGTEDHAWIKVEQLKPYHAHKEEMIKINKGKRFQQAVDAVEEFLRRAKGKDQTSSHNSSDDKNRRNSSEERSRPNSGDEKRKLSLSEGKVKKNMGEGKKRVSSGSSERGSKSPLKRAQEQSPRKRGRPPKDEKDLTIPESSTVKGMMAGPMAAFKWQPTASEPVKDADPHFHHFLLSQTEKPAVCYQAITKKLKICEEETGSTSIQAADSTAVNGSITPTDKKIGFLGLGLMGSGIVSNLLKMGHTVTVWNRTAEKCDLFIQEGARLGRTPAEVVSTCDITFACVSDPKAAKDLIEIRKWPKQQQDSDLRCCRAPEHLPGSLGYCFSLVSPQLVLGPSGVLQGIRPGKCYVDMSTVDADTVTELAQVIVSRGGRFLEAPVSGNQQLSNDGMLVILAAGDRGLYEDCSSCFQAMGKTSFFLGEVGNAAKMMLIVNMVQGSFMATIAEGLTLAQVTGQSQQTLLDILNQGQLASIFLDQKCQNILQGNFKPDFYLKYIQKDLRLAIALGDAVNHPTPMAAAANEVYKRAKALDQSDNDMSAVYRAYIH

SEQ ID NO: 850629 - protein, 561 aa, Homo sapiens
PTPMGGAGATCCSRRPVRRRWLGGKMAAVSLRLGDLVWGKLGRYPPWPGKIVNPPKDLKKPRGKKCFFVKFFGTEDHAWIKVEQLKPYHAHKEEMIKINKGKRFQQAVDAVEEFLRRAKGKDQTSSHNSSDDKNRRNSSEERSRPNSGDEKRKLSLSEGKVKKNMGEGKKRVSSGSSERGSKSPLKRAQEQSPRKRGRPPKDEKDLTIPESSTVKGMMAGPMAAFKWQPTASEPVKDADPHFHHFLLSQTEKETGSTSIQAADSTAVNGSITPTDKKIGFLGLGLMGSGIVSNLLKMGHTVTVWNRTAEKCDLFIQEGARLGRTPAEVVSTCDITFACVSDPKAAKDLVLGPSGVLQGIRPGKCYVDMSTVDADTVTELAQVIVSRGGRFLEAPVSGNQQLSNDGMLVILAAGDRGLYEDCSSCFQAMGKTSFFLGEVGNAAKMMLIVNMVQGSFMATIAEGLTLAQVTGQSQQTLLDILNQGQLASIFLDQKCQNILQGNFKPDFYLKYIQKDLRLAIALGDAVNHPTPMAAAANEVYKRAKALDQSDNDMSAVYRAYIH

SEQ ID NO: 850630 - protein, 555 aa, Homo sapiens
PTPMGGAGATCCSRRPVRRRWLGGKMAAVSLRLGDLVWGKLGRYPPWPGKIVNPPKDLKKPRGKKCFFVKFFGTEDHAWIKVEQLKPYHAHKEEMIKINKGKRFQQAVDAVEEFLRRAKGKDQTSSHNSSDDKNRRNSSEERSRPNSGDEKRKLSLSEGKVKKNMGEGKKRVSSGSSERGSKSPLKRAQEQSPRKRGRPPKDEKDLTIPESSTVKGMMAGPMAAFKWQPTASEPVKDADPHFHHFLLSQTEKPAVCYQAITKKLKICEEETGSTSIQAADSTAVNGSITPTDKKIGFLGLGLMGSGIVSNLLKMGHTVTVWNRTAEKEGARLGRTPAEVVSTCDITFACVSDPKAAKDLKKSGNEPKQQQDSDAEVIVSRGGRFLEAPVSGNQQLSNDGMLVILAAGDRGLYEDCSSCFQAMGKTSFFLGEVGNAAKMMLIVNMVQGSFMATIAEGLTLAQVTGQSQQTLLDILNQGQLASIFLDQKCQNILQGNFKPDFYLKYIQKDLRLAIALGDAVNHPTPMAAAANEVYKRAKALDQSDNDMSAVYRAYIH

SEQ ID NO: 850631 - protein, 276 aa, Homo sapiens
MGSGIVSNLLKMGHTVTVWNRTAEKCDLFIQEGARLGRTPAEVVSTCDITFACVSDPKAAKDLVLGPSGVLQGIRPGKCYVDMSTVDADTVTELAQVIVSRGGRFLEAPVSGNQQLSNDGMLVILAAGDRGLYEDCSSCFQAMGKTSFFLGEVGNAAKMMLIVNMVQGSFMATIAEGLTLAQVTGQSQQTLLDILNQGQLASIFLDQKCQNILQGNFKPDFYLKYIQKDLRLAIALGDAVNHPTPMAAAANEVYKRAKALDQSDNDMSAVYRAYIH

SEQ ID NO: 850632 - protein, 530 aa, Homo sapiens
PTPMGGAGATCCSRRPVRRRWLGGKMAAVSLRLGDLVWGKLGRYPPWPGKIVNPPKDLKKPRGKKCFFVKFFGTEDHAWIKVEQLKPYHAHKEEMIKINKGKRFQQAVDAVEEFLRRAKGKDQDLTIPESSTVKGMMAGPMAAFKWQPTASEPVKDADPHFHHFLLSQTEKPAVCYQAITKKLKICEEETGSTSIQAADSTAVNGSITPTDKKIGFLGLGLMGSGIVSNLLKMGHTVTVWNRTAEKEGARLGRTPAEVVSTCDITFACVSDPKAAKDLKKSGNEPKQQQDSDLRCCRAPEHLPGSLGYCFSLVSPQLVLGPSGVLQGIRPGKCYVDMSTVDADTVTELAQVIVSRGGRFLEAPVSGNQQLSNDGMLVILAAGDRGLYEDCSSCFQAMGKTSFFLGEVGNAAKMMLIVNMVQGSFMATIAEGLTLAQVTGQSQQTLLDILNQGQLASIFLDQKCQNILQGNFKPDFYLKYIQKDLRLAIALGDAVNHPTPMAAAANEVYKRAKALDQSDNDMSAVYRAYIH

SEQ ID NO: 850633 - protein, 47 aa, Homo sapiens
MMLIVNMVQGSFMATIAEGLTLAQVTGQSQQTLLDILNQGQLASIFL

SEQ ID NO: 850634 - protein, 276 aa, Homo sapiens
PTPMGGAGATCCSRRPVRRRWLGGKMAAVSLRLGDLVWGKLGRYPPWPGKIVNPPKDLKKPRGKKCFFVKFFGTEDHAWIKVEQLKPYHAHKEEMIKINKGKRFQQAVDAVEEFLRRAKGKDQDLTIPESSTVKGMMAGPMAAFKWQPTASEPVKDADPHFHHFLLSQTEKHLGTKSVASQCCVEAKNIVLNGKTIVMNDCIIRGDLANVRVGRHCVVKSRSVIRPPFKKFSKGVAFFPLHIGDHVFIEERSCGSPQAQIGSYVHVGKNCVIGRAC

SEQ ID NO: 850635 - protein, 578 aa, Homo sapiens
PTPMGGAGATCCSRRPVRRRWLGGKMAAVSLRLGDLVWGKLGRYPPWPGKIVNPPKDLKKPRGKKCFFVKFFGTEDHAWIKVEQLKPYHAHKEEMIKINKGKRFQQAVDAVEEFLRRAKGKDQTSSHNSSDDKNRRNSSEERSRPNSGDEKRKLSLSEGKVKKNMGEGKKRVSSGSSERGSKSPLKRAQEQSPRKRGRPPKDEKDLTIPESSTVKGMMAGPMAAFKWQPTASEPVKDADPHFHHFLLSQTEKPAVCYQAITKKLKICEEETGSTSIQAADSTAVNGSITPTDKKIGFLGLGLMGSGIVSNLLKMGHTVTVWNRTAEKCDLFIQEGARLGRTPAEVVSTCDITFACVSDPKAAKDLVLGPSGVLQGIRPGKCYVDMSTVDADTVTELAQVIVSRGGRFLEAPVSGNQQLSNDGMLVILAAGDRGLYEDCSSCFQAMGKTSFFLGEVGNAAKMMLIVNMVQGSFMATIAEGLTLAQVTGQSQQTLLDILNQGQLASIFLDQKCQNILQGNFKPDFYLKYIQKDLRLAIALGDAVNHPTPMAAAANEVYKRAKALDQSDNDMSAVYRAYIH

SEQ ID NO: 850636 - protein, 561 aa, Homo sapiens
PTPMGGAGATCCSRRPVRRRWLGGKMAAVSLRLGDLVWGKLGRYPPWPGKIVNPPKDLKKPRGKKCFFVKFFGTEDHAWIKVEQLKPYHAHKEEMIKINKGKRFQQAVDAVEEFLRRAKGKDQTSSHNSSDDKNRRNSSEERSRPNSGDEKRKLSLSEGKVKKNMGEGKKRVSSGSSERGSKSPLKRAQEQSPRKRGRPPKDEKDLTIPESSTVKGMMAGPMAAFKWQPTASEPVKDADPHFHHFLLSQTEKPAVCYQAITKKLKICEEETGSTSIQAADSTAVNGSITPTDKKIGFLGLGLMGSGIVSNLLKMGHTVTVWNRTAEKCDLFIQEGARLGRTPAEVVSTCDITFACVSDPKAAKDLIEIKEMSQNSSRILIEVIVSRGGRFLEAPVSGNQQLSNDGMLVILAAGDRGLYEDCSSCFQAMGKTSFFLGEVGNAAKMMLIVNMVQGSFMATIAEGLTLAQVTGQSQQTLLDILNQGQLASIFLDQKCQNILQGNFKPDFYLKYIQKDLRLAIALGDAVNHPTPMAAAANEVYKRAKALDQSDNDMSAVYRAYIH

SEQ ID NO: 850637 - protein, 414 aa, Homo sapiens
MGEGKKRVSSGSSERGSKSPLKRAQEQSPRKRGRPPKDEKDLTIPESSTVKGMMAGPMAAFKWQPTASEPVKDADPHFHHFLLSQTEKPAVCYQAITKKLKICEEETGSTSIQAADSTAVNGSITPTDKKIGFLGLGLMGSGIVSNLLKMGHTVTVWNRTAEKCDLFIQEGARLGRTPAEVVSTCDITFACVSDPKAAKDLVLGPSGVLQGIRPGKCYVDMSTVDADTVTELAQVIVSRGGRFLEAPVSGNQQLSNDGMLVILAAGDRGLYEDCSSCFQAMGKTSFFLGEVGNAAKMMLIVNMVQGSFMATIAEGLTLAQVTGQSQQTLLDILNQGQLASIFLDQKCQNILQGNFKPDFYLKYIQKDLRLAIALGDAVNHPTPMAAAANEVYKRAKALDQSDNDMSAVYRAYIH

SEQ ID NO: 850638 - protein, 270 aa, Homo sapiens
MGSGIVSNLLKMGHTVTVWNRTAEKEGARLGRTPAEVVSTCDITFACVSDPKAAKDLVLGPSGVLQGIRPGKCYVDMSTVDADTVTELAQVIVSRGGRFLEAPVSGNQQLSNDGMLVILAAGDRGLYEDCSSCFQAMGKTSFFLGEVGNAAKMMLIVNMVQGSFMATIAEGLTLAQVTGQSQQTLLDILNQGQLASIFLDQKCQNILQGNFKPDFYLKYIQKDLRLAIALGDAVNHPTPMAAAANEVYKRAKALDQSDNDMSAVYRAYIH

SEQ ID NO: 850639 - protein, 342 aa, Homo sapiens
PTPMGGAGATCCSRRPVRRRWLGGKMAAVSLRLGDLVWGKLGRYPPWPGKIVNPPKDLKKPRGKKCFFVKFFGTEDHAWIKVEQLKPYHAHKEEMIKINKGKRFQQAVDAVEEFLRRAKGKDQTSSHNSSDDKNRRNSSEERSRPNSGDEKRKLSLSEGKVKKNMGEGKKRVSSGSSERGSKSPLKRAQEQSPRKRGRPPKDEKDLTIPESSTVKGMMAGPMAAFKWQPTASEPVKDADPHFHHFLLSQTEKPAVCYQAITKKLKICEEETGSTSIQAADSTAVNGSITPTDKKIGFLGLGLMGSGIVSNLLKMGHTVTVWNRTAEKVSIQGWCLLDRWSLG

SEQ ID NO: 850640 - protein, 130 aa, Homo sapiens; identical to SEQ ID NO: 742470

SEQ ID NO: 850641 - protein, 433 aa, Homo sapiens
RRARAHGDGRMAAWGCVAALGAARGLCWRAARAAAGLQGRPARRCYAVGPAQSPPTFGFLLDIDGVLVRGHRVIPAALKAFRRLVNSQGQLRVPVVFVTNAGNILQHSKAQELSALLGCEVDADQVILSHSPMKLFSEYHEKRMLVSGQGPVMENAQGLGFRNVVTVDELRMAFPLLDMVDLERRLKTTPLPRNDFPRIEGVLLLGEPVRWETSLQLIMDVLLSNGSPGAGLATPPYPHLPVLASNMDLLWMAEAKMPRFGHGTFLLCLETIYQKVTGKELRYEGLMGKPSILTYQYAEDLIRRQAERRGWAAPIRKLYAVGDNPMSDVYGANLFHQYLQKATHDGAPELGAGGTRQQQPSASQSCISILVCTGVYNPRNPQSTEPVLGGGEPPFHGHRDLCFSPGLMEASHVVNDVNEAVQLVFRKEGWALE

SEQ ID NO: 850642 - protein, 433 aa, Homo sapiens; identical to SEQ ID NO: 850641

SEQ ID NO: 850643 - protein, 439 aa, Homo sapiens
RRARAHGDGRMAAWGCVAALGAARGLCWRAARAAAGLQGRPARRCYAVGPAQSPPTFGFLLDIDGVLVRGHRVIPAALKAFRRLVNSQGQLRVPVVFVTNAGNILQHSKAQELSALLGCEVDADQVILSHSPMKLFSEYHEKRMLVSGQGPVMENAQGLGFRNVVTVDELRMAFPLLDMVDLERRLKTTPLPRNDFPRIEGVLLLGEPVRWETSLQLIMDVLLSNGSPGAGLATPPYPHLPVLASNMDLLWMAEAKMPRFGHGTFLLCLETIYQKVTGKELRYEGLMGKPSILTYQYAEDLIRRQAERRGWAAPIRKLYAVGCGCPASDNPMSDVYGANLFHQYLQKATHDGAPELGAGGTRQQQPSASQSCISILVCTGVYNPRNPQSTEPVLGGGEPPFHGHRDLCFSPGLMEASHVVNDVNEAVQLVFRKEGWALE

SEQ ID NO: 850644 - protein, 365 aa, Homo sapiens
RRARAHGDGRMAAWGCVAALGAARGLCWRAARAAAGLQGRPARRCYAVGPAQVDADQVILSHSPMKLFSEYHEKRMLVSGQGPVMENAQGLGFRNVVTVDELRMAFPLLDMVDLERRLKTTPLPRNDFPRIEGVLLLGEPVRWETSLQLIMDVLLSNGSPGAGLATPPYPHLPVLASNMDLLWMAEAKMPRFGHGTFLLCLETIYQKVTGKELRYEGLMGKPSILTYQYAEDLIRRQAERRGWAAPIRKLYAVGDNPMSDVYGANLFHQYLQKATHDGAPELGAGGTRQQQPSASQSCISILVCTGVYNPRNPQSTEPVLGGGEPPFHGHRDLCFSPGLMEASHVVNDVNEAVQLVFRKEGWALE

SEQ ID NO: 850645 - protein, 450 aa, Homo sapiens
RRARAHGDGRMAAWGCVAALGAARGLCWRAARAAAGLQGRPARRCYAVGPAQSPPTFGFLLDIDGVLVRGHRVIPAALKAFRRLVNSQGQLRVPVVFVTNAGNILQHSKAQELSALLGCEVDADQVILSHSPMKLFSEYHEKRMLVSGQGPVMENAQGKASSPRTVQHYFLSLLQLGFRNVVTVDELRMAFPLLDMVDLERRLKTTPLPRNDFPRIEGVLLLGEPVRWETSLQLIMDVLLSNGSPGAGLATPPYPHLPVLASNMDLLWMAEAKMPRFGHGTFLLCLETIYQKVTGKELRYEGLMGKPSILTYQYAEDLIRRQAERRGWAAPIRKLYAVGDNPMSDVYGANLFHQYLQKATHDGAPELGAGGTRQQQPSASQSCISILVCTGVYNPRNPQSTEPVLGGGEPPFHGHRDLCFSPGLMEASHVVNDVNEAVQLVFRKEGWALE

SEQ ID NO: 850646 - protein, 147 aa, Homo sapiens
MGKPSILTYQYAEDLIRRQAERRGWAAPIRKLYAVGDNPMSDVYGANLFHQYLQKATHDGAPELGAGGTRQQQPSASQSCISILVCTGVYNPRNPQSTEPVLGGGEPPFHGHRDLCFSPGLMEASHVVNDVNEAVQLVFRKEGWALE

SEQ ID NO: 850647 - protein, 217 aa, Homo sapiens
RRARAHGDGRMAAWGCVAALGAARGLCWRAARAAAGLQGRPARRCYAVGPAQSPPTFGFLLDIDGVLVRGHRVIPAALKAFRRLVNSQGQLRVPVVFVTNAGNILQHSKAQELSALLGCEVDADQVILSHSPMKLFSEYHEKRMLVSGQGPVMENAQGLGFRNVVTVDELRMAFPLLDMVDLERRLKTTPLPRNDFPRIEGLDMAPFCCAWKPFTRK

SEQ ID NO: 850648 - protein, 104 aa, Homo sapiens
MPPGARGVGRVRLARGFPMAQGAGGTRQQQPSASQSCISILVCTGVYNPRNPQSTEPVLGGGEPPFHGHRDLCFSPGLMEASHVVNDVNEAVQLVFRKEGWALE

SEQ ID NO: 850649 - protein, 165 aa, Homo sapiens
TPCTCARRRPDGCVGLCGCARRGAWALLAGGARGCGAPGPPRPQVLCCGPRSGEDVRVLAEPLATQGRRRGGEPRGRRGGRAGIPASWELPGPSSRPSASRSCWRADAPCLPLTRWRPRKRYSRGRALVGRPGPGCLSAPALPGSFRVPVFPARLLISTMRTFGS

SEQ ID NO: 850650 - protein, 433 aa, Homo sapiens; identical to SEQ ID NO: 850641

SEQ ID NO: 850651 - protein, 393 aa, Homo sapiens
MYAWFFLPSFSQSPPTFGFLLDIDGVLVRGHRVIPAALKAFRRLVNSQGQLRVPVVFVTNAGNILQHSKAQELSALLGCEVDADQVILSHSPMKLFSEYHEKRMLVSGQGPVMENAQGLGFRNVVTVDELRMAFPLLDMVDLERRLKTTPLPRNDFPRIEGVLLLGEPVRWETSLQLIMDVLLSNGSPGAGLATPPYPHLPVLASNMDLLWMAEAKMPRFGHGTFLLCLETIYQKVTGKELRYEGLMGKPSILTYQYAEDLIRRQAERRGWAAPIRKLYAVGDNPMSDVYGANLFHQYLQKATHDGAPELGAGGTRQQQPSASQSCISILVCTGVYNPRNPQSTEPVLGGGEPPFHGHRDLCFSPGLMEASHVVNDVNEAVQLVFRKEGWALE

SEQ ID NO: 850652 - protein, 301 aa, Homo sapiens
MKLFSEYHEKRMLVSGQGPVMENAQGLGFRNVVTVDELRMAFPLLDMVDLERRLKTTPLPRNDFPRIEGVLLLGEPVRWETSLQLIMDVLLSNGSPGAGLATPPYPHLPVLASNMDLLWMAEAKMPRFGHGTFLLCLETIYQKVTGKELRYEGLMGKPSILTYQYAEDLIRRQAERRGWAAPIRKLYAVGDNPMSDVYGANLFHQYLQKATHDGAPELGAGGTRQQQPSASQSCISILVCTGVYNPRNPQSTEPVLGGGEPPFHGHRDLCFSPGLMEASHVVNDVNEAVQLVFRKEGWALE

SEQ ID NO: 850653 - protein, 301 aa, Homo sapiens; identical to SEQ ID NO: 850652

SEQ ID NO: 850654 - protein, 338 aa, Homo sapiens
VSSPTRERQLTTLPPGDFTHGVLPVLWPHLAIVFSPFLHLSQSSPAFPWLGLDHGCGVCGVCLPSPPSTLEVGLWFSWSGRRLVLIAISFVSLQPLPRNDFPRIEGVLLLGEPVRWETSLQLIMDVLLSNGSPGAGLATPPYPHLPVLASNMDLLWMAEAKMPRFGHGTFLLCLETIYQKVTGKELRYEGLMGKPSILTYQYAEDLIRRQAERRGWAAPIRKLYAVGDNPMSDVYGANLFHQYLQKATHDGAPELGAGGTRQQQPSASQSCISILVCTGVYNPRNPQSTEPVLGGGEPPFHGHRDLCFSPGLMEASHVVNDVNEAVQLVFRKEGWALE

SEQ ID NO: 850655 - protein, 147 aa, Homo sapiens; identical to SEQ ID NO: 850646

SEQ ID NO: 850656 - protein, 114 aa, Homo sapiens
MKLFSEYHEKRMLVSGQGPVMENAQGLGFRNVVTVDELRMAFPLLDMVDLERRLKTTPLPRNDFPRIEETGSHYVAQAGLKLLSSSNPTTLASQSAGITDTSHRTQPWDGFFKN

SEQ ID NO: 850657 - protein, 459 aa, Homo sapiens
MSNCLQNFLKITSTRLLCSRLCQQLRSKRKFFGTVPISRLHRRVVITGIGLVTPLGVGTHLVWDRLIGGESGIVSLVGEEYKSIPCSVAAYVPRGSDEGQFNEQNFVSKSDIKSMSSPTIMAIGAAELAMKDSGWHPQSEADQVATGVAIGMGMIPLEVVSETALNFQTKGYNKVSPFFVPKILVNMAAGQVSIRYKLKGPNHAVSTACTTGAHAVGDSFRFIAHGDADVMVAGGTDSCISPLSLAGFSRARALSTNSDPKLACRPFHPKRDGFVMGEGAAVLVLEEYEHAVQRRARIYAEVLGYGLSGDAGHITAPDPEGEGALRCMAAALKDAGVQPEEISYINAHATSTPLGDAAENKAIKHLFKDHAYALAVSSTKGATGHLLGAAGAVEAAFTTLACYYQKLPPTLNLDCSEPEFDLNYVPLKAQEWKTEKRFIGLTNSFGFGGTNATLCIAGL

SEQ ID NO: 850658 - protein, 459 aa, Homo sapiens; identical to SEQ ID NO: 850657

SEQ ID NO: 850659 - protein, 80 aa, Homo sapiens [sequence omitted]

SEQ ID NO: 850660 - protein, 459 aa, Homo sapiens; identical to SEQ ID NO: 850657

SEQ ID NO: 850661 - protein, 184 aa, Homo sapiens
MGEGAAVLVLEEYEHAVQRRARIYAEVLGYGLSGDAGHITAPDPEGEGALRCMAAALKDAGVQPEEISYINAHATSTPLGDAAENKAIKHLFKDHAYALAVSSTKGATGHLLGAAGAVEAAFTTLACYYQKLPPTLNLDCSEPEFDLNYVPLKAQEWKTEKRFIGLTNSFGFGGTNATLCIAGL

SEQ ID NO: 850662 - protein, 121 aa, Homo sapiens
PEEISYINAHATSTPLGDAAENKAIKHLFKDHAYALAVSSTKGATGHLLGAAGAVEAAFTTLACYYQKLPPTLNLDCSEPEFDLNYVPLKAQEWKTEKRFIGLTNSFGFGGTNATLCIAGL

SEQ ID NO: 850663 - protein, 565 aa, Homo sapiens
MNRSIPVEVDESEPYPSQLLKPIPEYSPEEESEPPAPNIRNMAPNSLSAPTMLHNSSGDFSQAHSTLKLANHQRPVSRQVTCLRTQVLEDSEDSFCRRHPGLGKAFPSGCSAVSEPASESVVGALPAEHQFSFMEKRNQWLVSQLSAASPDTGHDSDKSDQSLPNASADSLGGSQEMVQRPQPHRNRAGLDLPTIDTGYDSQPQDVLGIRQLERPLPLTSVCYPQDLPRPLRSREFPQFEPQRYPACAQMLPPNLSPHAPWNYHYHCPGSPDHQVPYGHDYPRAAYQQVIQPALPGQPLPGASVRGLHPVQKVILNYPSPWDQEERPAQRDCSFPGLPRHQDQPHHQPPNRAGAPGESLECPAELRPQVPQPPSPAAVPRPPSNPPARGTLKTSNLPEELRKVFITYSMDTAMEVVKFVNFLLVNGFQTAIDIFEDRIRGIDIIKWMERYLRDKTVMIIVAISPKYKQDVEGAESQLDEDEHGLHTKYIHRMMQIEFIKQGSMNFRFIPVLFPNAKKEHVPTWLQNTHVYSWPKNKKNILLRLLREEEYVAPPRGPLPTLQVVPL

SEQ ID NO: 850664 - protein, 565 aa, Homo sapiens; identical to SEQ ID NO: 850663

SEQ ID NO: 850665 - protein, 565 aa, Homo sapiens; identical to SEQ ID NO: 850663

SEQ ID NO: 850666 - protein, 610 aa, Homo sapiens
ERTWPDDQKRLRVDYAPRGHAVSVRWCIYQTRMSANAFLMDVARLTSNSRKVRCSHEKPTLAQEVIAREQERESPATLCADDSEDTMAPNSLSAPTMLHNSSGDFSQAHSTLKLANHQRPVSRQVTCLRTQVLEDSEDSFCRRHPGLGKAFPSGCSAVSEPASESVVGALPAEHQFSFMEKRNQWLVSQLSAASPDTGHDSDKSDQSLPNASADSLGGSQEMVQRPQPHRNRAGLDLPTIDTGYDSQPQDVLGIRQLERPLPLTSVCYPQDLPRPLRSREFPQFEPQRYPACAQMLPPNLSPHAPWNYHYHCPGSPDHQVPYGHDYPRAAYQQVIQPALPGQPLPGASVRGLHPVQKVILNYPSPWDQEERPAQRDCSFPGLPRHQDQPHHQPPNRAGAPGESLECPAELRPQVPQPPSPAAVPRPPSNPPARGTLKTSNLPEELRKVFITYSMDTAMEVVKFVNFLLVNGFQTAIDIFEDRIRGIDIIKWMERYLRDKTVMIIVAISPKYKQDVEGAESQLDEDEHGLHTKYIHRMMQIEFIKQGSMNFRFIPVLFPNAKKEHVPTWLQNTHVYSWPKNKKNILLRLLREEEYVAPPRGPLPTLQVVPL

SEQ ID NO: 850667 - protein, 565 aa, Homo sapiens; identical to SEQ ID NO: 850663

SEQ ID NO: 850668 - protein, 109 aa, Homo sapiens
MIIVAISPKYKQDVEGAESQLDEDEHGLHTKYIHRMMQIEFIKQGSMNFRFIPVLFPNAKKEHVPTWLQNTHVYSWPKNKKNILLRLLREEEYVAPPRGPLPTLQVVPL

SEQ ID NO: 850669 - protein, 278 aa, Homo sapiens [sequence omitted]

SEQ ID NO: 850670 - protein, 565 aa, Homo sapiens; identical to SEQ ID NO: 850663

SEQ ID NO: 850671 - protein, 116 aa, Homo sapiens
VCISSTRFIHIQADMHTETHILLSFFTQNSSIVCTLLCAWLLKKNSIYLRDHSISVTKIYFFMYSKHTRSSPHYDNFSFLNTGQLIFICVFPLLVNDFYHRMVQSHSLNCLPDKIS

SEQ ID NO: 850672 - protein, 565 aa, Homo sapiens; identical to SEQ ID NO: 850663

SEQ ID NO: 850673 - protein, 540 aa, Homo sapiens
MNRSIPVEVDESEPYPSQLLKPIPEYSPEEESEPPAPNIRNMAPNSLSAPTMLHNSSGDFSQAHSTLKLANHQRPVSRQVTCLRTQVLEDSEDSFCRRHPGLGKAFPSGCSAVSEPASESVVGALPAEHQFSFMEKRNQWLVSQLSAASPDTGHDSDKSDQSLPNASADSLGGSQEMVQRPQPHRNRAGLDLPTIDTGYDSQPQDVLGIRQLERPLPLTSVCYPQDLPRPLRSREFPQFEPQRYPACAQMLPPNLSPHAPWNYHYHCPGSPDHQVPYGHDYPRAAYQQVIQPALPGQPLPGASVRGLHPVQKVILNYPSPWDQEERPAQRDCSFPGLPRHQDQPHHQPPNRAGAPGESLECPAELRPQVPQPPSPAAVPRPPSNPPARGTLKTSNLPEELRKVFITYSMDTAMEVVKFVNFLLVNGFQTAIDIFEDRIRGIDIIKWMERYLRDKTVMIIVAISPKYKQDVEGAESQLDEDEHGLHTKYIHRMEHVPTWLQNTHVYSWPKNKKNILLRLLREEEYVAPPRGPLPTLQVVPL

SEQ ID NO: 850674 - protein, 109 aa, Homo sapiens; identical to SEQ ID NO: 850668

SEQ ID NO: 850675 - protein, 109 aa, Homo sapiens; identical to SEQ ID NO: 850668

SEQ ID NO: 850676 - protein, 1539 aa, Homo sapiens
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKIVIEEGGYEAICKDRRWARVAQRLHYPPGKNIGSLLRSHYERIIYPYEMFQSGANHVQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSFEELRALESEARERRFPNSELLQRLKNCLSEVEACIAQVLGLVSGQVARMDTPQLTLTELRVLLEQMGSLPCAMHQIGDVKDVLEQVEAYQAEAREALATLPSSPGLLRSLLERGQQLGVEVPEAHQLQQQVEQAQWLDEVKQALAPSAHRGSLVIMQGLLVMGAKIASSPSVDKARAELQELLTIAERWEEKAHFCLEARQKHPPATLEAIIRETENIPVHLPNIQALKEALTKAQAWIADVDEIQNGDHYPCLDDLEGLVAVGRDLPVGLEELRQLELQVLTAHSWREKASKTFLKKNSCYTLLEVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACDPIREGSGNNISKVQGLLENGDSVTSPENMAPGKGSDLELLSSLLPQLTGPVLELPEAIRAPLEELMMEGDLLEVTLDENHSIWQLLQAGQPPDLDRIRTLLELEKFEHQGSRTRSRALERRRRRQKVDQGRNVENLVQQELQSKRARSSGIMSQVGREEEHYQEKADRENMFLTPSTDHSPFLKGNQNSLQHKDSGSSAACPSLMPLLQLSYSDEQQL

SEQ ID NO: 850677 - protein, 442 aa, Homo sapiens
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKIVIEEGGYEAICKDRRWARVAQRLHYPPGKNIGSLLRSHYERIIYPYEMFQSGANHVPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVEPDGTGLTCSLAPNIISQL

SEQ ID NO: 850678 - protein, 231 aa, Homo sapiens [sequence omitted]

SEQ ID NO: 850679 - protein, 1417 aa, Homo sapiens
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKIVIEEGGYEAICKDRRWARVAQRLHYPPGKNIGSLLRSHYERIIYPYEMFQSGANHVPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSFEELRALESEARERRFPNSELLQRLKNCLSEVEACIAQVLGLVSGQVARMDTPQLTLTELRVLLEQMGSLPCAMHQIGDVKGLLVMGAKIASSPSVDKARAELQELLTIAERWEEKAHFCLEARQKHPPATLEAIIRETENIPVHLPNIQALKEALTKAQAWIADVDEIQNGDHYPCLDDLEGLVAVGRDLPVGLEELRQLELQVLTAHSWREKASKTFLKKNSCYTLLEVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACDPIREGSGNNISKVQGLLENGDSVTSPENMAPGKGSDLELLSSLLPQLTGPVLELPEAIRAPLEELMMEGDLLEVTLDENHSIWQLLQAGQPPDLDRIRTLLELEKFEHQGSRTRSRALERRRRRQKVDQGRNVENLVQQELQSKRARSSGIMSQVGREEEHYQEKADRENMFLTPSTDHSPFLKGNQNSLQHKDSGSSAACPSLMPLLQLSYSDEQQL

SEQ ID NO: 850680 - protein, 788 aa, Homo sapiens
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKIVIEEGGYEAICKDRRWARVAQRLHYPPGKNIGSLLRSHYERIIYPYEMFQSGANHVQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRRVFSTFLFC

SEQ ID NO: 850681 - protein, 1482 aa, Homo sapiens
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSFEELRALESEARERRFPNSELLQRLKNCLSEVEACIAQVLGLVSGQVARMDTPQLTLTELRVLLEQMGSLPCAMHQIGDVKDVLEQVEAYQAEAREALATLPSSPGLLRSLLERGQQLGVEVPEAHQLQQQVEQAQWLDEVKQALAPSAHRGSLVIMQGLLVMGAKIASSPSVDKARAELQELLTIAERWEEKAHFCLEARQKHPPATLEAIIRETENIPVHLPNIQALKEALTKAQAWIADVDEIQNGDHYPCLDDLEGLVAVGRDLPVGLEELRQLELQVLTAHSWREKASKTFLKKNSCYTLLEVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACDPIREGSGNNISKVQGLLENGDSVTSPENMAPGKGSDLELLSSLLPQLTGPVLELPEAIRAPLEELMMEGDLLEVTLDENHSIWQLLQAGQPPDLDRIRTLLELEKFEHQGSRTRSRALERRRRRQKVDQGRNVENLVQQELQSKRARSSGIMSQVGREEEHYQEKADRENMFLTPSTDHSPFLKGNQNSLQHKDSGSSAACPSLMPLLQLSYSDEQQL

SEQ ID NO: 850682 - protein, 1462 aa, Homo sapiens
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKIVIEEGGYEAICKDRRWARVAQRLHYPPGKNIGSLLRSHYERIIYPYEMFQSGANHVQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSFEELRALESEARERRFPNSELLQRLKNCLSEVEACIAQVLGLVSGQVARMDTPQLTLTELRVLLEQMGSLPCAMHQIGDVKGLLVMGAKIASSPSVDKARAELQELLTIAERWEEKAHFCLEARQKHPPATLEAIIRETENIPVHLPNIQALKEALTKAQAWIADVDEIQNGDHYPCLDDLEGLVAVGRDLPVGLEELRQLELQVLTAHSWREKASKTFLKKNSCYTLLEVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACDPIREGSGNNISKVQGLLENGDSVTSPENMAPGKGSDLELLSSLLPQLTGPVLELPEAIRAPLEELMMEGDLLEVTLDENHSIWQLLQAGQPPDLDRIRTLLELEKFEHQGSRTRSRALERRRRRQKVDQGRNVENLVQQELQSKRARSSGIMSQVGREEEHYQEKADRENMFLTPSTDHSPFLKGNQNSLQHKDSGSSAACPSLMPLLQLSYSDEQQL

SEQ ID NO: 850683 - protein, 887 aa, Homo sapiens
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKIVIEEGGYEAICKDRRWARVAQRLHYPPGKNIGSLLRSHYERIIYPYEMFQSGANHVQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSGDRKWKEPLCKPYFFLLGILNLPFLLTLPTCCNLHSPGFEELRALESEARERRFPNSELLQRLKNCLSEVEACIAQVLGLVSGQVARYVRGEGKEGCQCVKMNNKNG

SEQ ID NO: 850684 - protein, 214 aa, Homo sapiens
MNVFRILGDLSHLLAMILLLGKIWRSKCCKGISGKSQILFALVFTTRYLDLFTNFISIYNTVMKVVFLLCAYVTVYMIYGKFRKTFDSENDTFRLEFLLVPVIGLSFLENYSFTLLEILWTFSIYLESVAILPQLFMISKTGEAETITTHYLFFLGLYRALYLANWIRRYQTENFYDQIAVVSGVVQTIFYCDFFYLYVTKVLKGKKLSLPMPI

SEQ ID NO: 850685 - protein, 126 aa, Homo sapiens
MNVFRILGDLSHLLAMILLLGKIWRSKCCKGISGKSQILFALVFTTRYLDLFTNFISIYNTVMKVVFLLCAYVTVYMIYGKFRKTFDSENDTFRLEFLLVPVIGLSFLGISGYPAPALHDQQDWRG

SEQ ID NO: 850686 - protein, 214 aa, Homo sapiens; identical to SEQ ID NO: 850684

SEQ ID NO: 850687 - protein, 220 aa, Homo sapiens
MNVFRILGDLSHLLAMILLLGKIWRSKCCKGISGKSQILFALVFTTRYLDLFTNFISIYNTVMKVVFLLCAYVTVYMIYGKFRKTFDSENDTFRLEFLLVPVIGLSFLENYSFTLLEILWTFSIYLESVAILPQLFMISKTGEAETITTHYLFFLGLYRALYLANWIRRYQTENFYDQIAVVSGVVQTIFYCDFFYLYVTKGRSWDDSNADTGLRSYSSI

SEQ ID NO: 850688 - protein, 214 aa, Homo sapiens; identical to SEQ ID NO: 850684

SEQ ID NO: 850689 - protein, 156 aa, Homo sapiens
AGLERAHRRQQWPSLGGMAVCARLCGVGPSRGCRRRQQRRGPAETAAADSEPDTDPEEERIEASAGVGGGLCAGPSPPPPRCSLLELPPELLVEIFASLPGTDLPSLAQVCTKRARVVAGRAPGSPSQALPSPGQRRPARAQMGHLVRMVASLGMP

SEQ ID NO: 850690 - protein, 112 aa, Homo sapiens
GPRKICTRYEPGLFIFESPGFLSLSHSGAGSSLLSGVGLPAVQLCTPERVLCHLFGNDVIEDFREVIGGFSVPALNVHLHEEVANDFCRLRFKAGGIGVPQPTWAVTSSVHC

SEQ ID NO: 850691 - protein, 556 aa, Homo sapiens
AGLERAHRRQQWPSLGGMAVCARLCGVGPSRGCRRRQQRRGPAETAAADSEPDTDPEEERIEASAGVGGGLCAGPSPPPPRCSLLELPPELLVEIFASLPGTDLPSLAQVCTKFRRILHTDTIWRRRCREEYGVCENLRKLEITGVSCRDVYAKLLHRYRHILGLWQPDIGPYGGLLNVVVDGLFIIGWMYLPPHDPHVDDPMRFKPLFRIHLMERKAATVECMYGHKGPHHGHIQIVKKDEFSTKCNQTDHHRMSGGRQEEFRTWLREEWGRTLEDIFHEHMQELILMKFIYTSQYDNCLTYRRIYLPPSRPDDLIKPGLFKGTYGSHGLEIVMLSFHGRRARGTKITGDPNIPAGQQTVEIDLRHRIQLPDLENQRNFNELSRIVLEVRERVRQEQQEGGHEAGEGRGRQGPRESQPSPAQPRAEAPSKGPDGTPGEDGGEPGDAVAAAEQPAQCGQGQPFVLPVGVSSRNEDYPRTCRMCFYGTGLIAGHGFTSPERTPGVFILFDEDRFGFVWLELKSFSLYSRVQATFRNADAPSPQAFDEMLKNIQSLTS

SEQ ID NO: 850692 - protein, 400 aa, Homo sapiens
IAMSGRGNRTEGADIGHTEDCERVVDGLFIIGWMYLPPHDPHVDDPMRFKPLFRIHLMERKAATVECMYGHKGPHHGHIQIVKKDEFSTKCNQTDHHRMSGGRQEEFRTWLREEWGRTLEDIFHEHMQELILMKFIYTSQYDNCLTYRRIYLPPSRPDDLIKPGLFKGTYGSHGLEIVMLSFHGRRARGTKITGDPNIPAGQQTVEIDLRHRIQLPDLENQRNFNELSRIVLEVRERVRQEQQEGGHEAGEGRGRQGPRESQPSPAQPRAEAPSKGPDGTPGEDGGEPGDAVAAAEQPAQCGQGQPFVLPVGVSSRNEDYPRTCRMCFYGTGLIAGHGFTSPERTPGVFILFDEDRFGFVWLELKSFSLYSRVQATFRNADAPSPQAFDEMLKNIQSLTS

SEQ ID NO: 850693 - protein, 556 aa, Homo sapiens; identical to SEQ ID NO: 850691

SEQ ID NO: 850694 - protein, 483 aa, Homo sapiens
AGLERAHRRQQWPSLGGMAVCARLCGVGPSRGCRRRQQRRGPAETAAADSEPDTDPEEERIEASAGVGGGLCAGPSPPPPRCSLLELPPELLVEIFASLPGTDLPSLAQVCTKFRRILHTDTIWRRRCREEYGVCENLRKLEITGVSCRDVYAKLLHRYRHILGLWQPDIGPYGGLLNVVVDGLFIIGWMYLPPHDPHVDDPMRFKPLFRIHLMERKAATVECMYGHKGPHHGHIQIVKKDEFSTKCNQTDHHRMSGGRQEEFRTWLREEWGRTLEDIFHEHMQELILMKFIYTSQYDNCLTYRRIYLPPSRPDDLIKPGLFKGTYGSHGLEIVMLSFHGRRARGTKITGDPNIPAGQQTVEIDLRHRIQLPDLENQRNFNELSRIVLEVRERVRQEQQEGGHEAGEGRGRQGPRESQPSPAQPRAEAPSKGPDGTPGEDGGEPGDAVAAAEQPAQCGQGQPFVLPVGVSSRNEDYPRTCRMW

SEQ ID NO: 850695 - protein, 556 aa, Homo sapiens; identical to SEQ ID NO: 850691

SEQ ID NO: 850696 - protein, 104 aa, Homo sapiens
EDLEAAWFVIHDVPGYVHTGPGRHCTTGVGLPAVQLCTPERVLCHLFGNDVIEDFREVIGGFSVPALNVHLHEEVANDFCRLRFKAGGIGVPQPTWAVTSSVHC

SEQ ID NO: 850697 - protein, 443 aa, Homo sapiens
MATVCWFVFCENRKKKSEYGVCENLRKLEITGVSCRDVYAKLLHRYRHILGLWQPDIGPYGGLLNVVVDGLFIIGWMYLPPHDPHVDDPMRFKPLFRIHLMERKAATVECMYGHKGPHHGHIQIVKKDEFSTKCNQTDHHRMSGGRQEEFRTWLREEWGRTLEDIFHEHMQELILMKFIYTSQYDNCLTYRRIYLPPSRPDDLIKPGLFKGTYGSHGLEIVMLSFHGRRARGTKITGDPNIPAGQQTVEIDLRHRIQLPDLENQRNFNELSRIVLEVRERVRQEQQEGGHEAGEGRGRQGPRESQPSPAQPRAEAPSKGPDGTPGEDGGEPGDAVAAAEQPAQCGQGQPFVLPVGVSSRNEDYPRTCRMCFYGTGLIAGHGFTSPERTPGVFILFDEDRFGFVWLELKSFSLYSRVQATFRNADAPSPQAFDEMLKNIQSLTS

SEQ ID NO: 850698 - protein, 556 aa, Homo sapiens; identical to SEQ ID NO: 850691

SEQ ID NO: 850699 - protein, 106 aa, Homo sapiens
RRTAAERQTAAARRRGGQRRRGGQRRRGGQRRRGGETDSGGEADSGGEARSGGAGAERRWRRLWRGEAQAQAPLPSCERVFCLLLSQFIHSKKIFHFIQVKQNLLE

SEQ ID NO: 850700 - protein, 147 aa, Homo sapiens
VAAEESLAEGGPRSGGRRAARARAREAAVGEVERRSRGEEEEGLSGGGPRVPCLYGEKQTMDYDFKAKLAAERERVEDLFEYEGCKVGRGTYGHVYKARRKDGFQEGFVYGPQALEVADFSAEGKACKLGASQRLETSKYPSNGRRS

SEQ ID NO: 850701 - protein, 504 aa, Homo sapiens
REGRPWYAGAHALWGRGCGGPRFQEGFVYGPQALEVADFSAEGKAKDEKEYALKQIEGTGISMSACREIALLRELKHPNVIALQKVFLSHSDRKVWLLFDYAEHDLWHIIKFHRASKANKKPMQLPRSMVKSLLYQILDGIHYLHANWVLHRDLKPANILVMGEGPERGRVKIADMGFARLFNSPLKPLADLDPVVVTFWYRAPELLLGARHYTKAIDIWAIGCIFAELLTSEPIFHCRQEDIKTSNPFHHDQLDRIFSVMGFPADKDWEDIRKMPEYPTLQKDFRRTTYANSSLIKYMEKHKVKPDSKVFLLLQKLLTMDPTKRITSEQALQDPYFQEDPLPTLDVFAGCQIPYPKREFLNEDDPEEKGDKNQQQQQNQHQQPTAPPQQAAAPPQAPPPQQNSTQTNGTAGGAGAGVGGTGAGLQHSQDSSLNQVPPNKKPRLGPSGANSGGPVMPSDYQHSSSRLNYQSSVQGSSQSQSTLGYSSSSQQSSQYHPSHQAHRY

SEQ ID NO: 850702 - protein, 502 aa, Homo sapiens
MDYDFKAKLAAERERVEDLFEYEGCKVGRGTYGHVYKARRKDGKDEKEYALKQIEGTGISMSACREIALLRELKHPNVIALQKVFLSHSDRKVWLLFDYAEHDLWHIIKFHRASKANKKPMQLPRSMVKSLLYQILDGIHYLHANWVLHRDLKPANILVMGEGPERGRVKIADMGFARLFNSPLKPLADLDPVVVTFWYRAPELLLGARHYTKAIDIWAIGCIFAELLTSEPIFHCRQEDIKTSNPFHHDQLDRIFSVMGFPADKDWEDIRKMPEYPTLQKDFRRTTYANSSLIKYMEKHKVKPDSKVFLLLQKLLTMDPTKRITSEQALQDPYFQEDPLPTLDVFAGCQIPYPKREFLNEDDPEEKGDKNQQQQQNQHQQPTAPPQQAAAPPQAPPPQQNSTQTNGTAGGAGAGVGGTGAGLQHSQDSSLNQVPPNKKPRLGPSGANSGGPVMPSDYQHSSSRLNYQSSVQGSSQSQSTLGYSSSSQQSSQYHPSHQAHRY

SEQ ID NO: 850703 - protein, 502 aa, Homo sapiens; identical to SEQ ID NO: 850702

SEQ ID NO: 850704 - protein, 68 aa, Homo sapiens
GRHSPAPANEQRDGGRGNRRTHCPRKETSCGTTVLTSPRLPSHCSQPFSKELRENCRNTLGSLYWLSS

SEQ ID NO: 850705 - protein, 108 aa, Homo sapiens
VAAEESLAEGGPRSGGRRAARARAREAAVGEVERRSRGEEEEGLSGGGPRVPCLYGGSRQWIMISRRSWRRSGSGWRICLSTKGAKWDAAPTVTSTRRGGKMGVEGEL

SEQ ID NO: 850706 - protein, 502 aa, Homo sapiens; identical to SEQ ID NO: 850702

SEQ ID NO: 850707 - protein, 502 aa, Homo sapiens; identical to SEQ ID NO: 850702

SEQ ID NO: 850708 - protein, 163 aa, Homo sapiens
RSRLARVLALPATWRDGWVGSQSGRARGARRRGSRGCVRTPTPRGARSARLPRAAPSRTSNSRGAARSEASVPSQRGALRVLGDGGGTRVGTAVEEEFVGSSLLGERSGQAELRCGVAAPALGSDGRCGTSNRLSASRGRRFETSPGSLSGERGLGSSPAPRL

SEQ ID NO: 850709 - protein, 175 aa, Homo sapiens
ATSETGASVSTRGSHFVGSAAHEVAVAKSFTIECRVPTVEPLDSLTLFLFRGNETLHYETFGKAAPAPQEATATFNSTADREDGHRNFSCLAVLDLMSRGGNIFHKHSAPKMLEIYEPVSDSQMVIIVTVVSVLLSLFVTSVLLCFIFGQHLRQQRMGTYGVRAAWRRLPQAFRP

SEQ ID NO: 850710 - protein, 275 aa, Homo sapiens
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIYEPVSDSQMVIIVTVVSVLLSLFVTSVLLCFIFGQHLRQQRMGTYGVRAAWRRLPQAFRP

SEQ ID NO: 850711 - protein, 275 aa, Homo sapiens; identical to SEQ ID NO: 850710

SEQ ID NO: 850712 - protein, 275 aa, Homo sapiens; identical to SEQ ID NO: 850710

SEQ ID NO: 850713 - protein, 174 aa, Homo sapiens
MNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIYEPVSDSQMVIIVTVVSVLLSLFVTSVLLCFIFGQHLRQQRMGTYGVRAAWRRLPQAFRP

SEQ ID NO: 850714 - protein, 273 aa, Homo sapiens
MEDIRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIYEPVSDSQMVIIVTVVSVLLSLFVTSVLLCFIFGQHLRQQRMGTYGVRAAWRRLPQAFRP

SEQ ID NO: 850715 - protein, 154 aa, Homo sapiens
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSPQPHSTARLTERMATATSPAWLCWT

SEQ ID NO: 850716 - protein, 224 aa, Homo sapiens
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSSVLLCFIFGQHLRQQRMGTYGVRAAWRRLPQAFRP

SEQ ID NO: 850717 - protein, 149 aa, Homo sapiens
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYREWLCCGALLSPGTEAVSTECTQSPSVPAPGHCHRGALPP

SEQ ID NO: 850718 - protein, 140 aa, Homo sapiens
MSSFGYRTLTVALFTLICCPGSDEKVFEVHVRPKKLAVEPKGSLEVNCSTTCNQRLAVLDLMSRGGNIFHKHSAPKMLEIYEPVSDSQMVIIVTVVSVLLSLFVTSVLLCFIFGQHLRQQRMGTYGVRAAWRRLPQAFRP

SEQ ID NO: 850719 - protein, 261 aa, Homo sapiens
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIYEAVSDSPMVIKSHRGRGVAWLGICLVGYLRQIGQRDGPRVEGVGG

SEQ ID NO: 850720 - protein, 275 aa, Homo sapiens; identical to SEQ ID NO: 850710

SEQ ID NO: 850721 - protein, 278 aa, Homo sapiens
MAHCTSLGSGDPPTSASWVAGITGSDEKVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIYEPVSDSQMVIIVTVVSVLLSLFVTSVLLCFIFGQHLRQQRMGTYGVRAAWRRLPQAFRP

SEQ ID NO: 850722 - protein, 330 aa, Homo sapiens
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYLGCTISEPCPCRHLVTGNHHVCKTTTQSSLHPQLRPLPLCTGAGQATSSPTVEHHEPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIYEPVSDSQMVIIVTVVSVLLSLFVTSVLLCFIFGQHLRQQRMGTYGVRAAWRRLPQAFRP

SEQ ID NO: 850723 - protein, 275 aa, Homo sapiens; identical to SEQ ID NO: 850710

SEQ ID NO: 850724 - protein, 116 aa, Homo sapiens
MNQTDKNQQEIPSYLNDEPPEGSMKDHPQQQPGMLSRVTGGIFSVTKGAVGATIGGVAWIGGKSLEVTKTAVTTVPSMGIGLVKGGVSAVAGGVTAVGSAVVNKVPLTGKKKDKSD

SEQ ID NO: 850725 - protein, 116 aa, Homo sapiens; identical to SEQ ID NO: 850724

SEQ ID NO: 850726 - protein, 116 aa, Homo sapiens; identical to SEQ ID NO: 850724

SEQ ID NO: 850727 - protein, 289 aa, Homo sapiens
AGPCENGWACARWAREGPGLHERACASDWSRGRRRELRRRRRGRVASGATSAARGLRLHHRRHSLPAPHPERTPLEPRLPGVVPAAAAAQAASALLCAGPLTPPGPSPSAGRDPGAFETSAGVSALRGSPGISIQHQQAGVQWLDLHSLQHPSPRFKRFSCLSLPGSWDYQEIMNQTDKNQQEIPSYLNDEPPEGSMKDHPQQQPGMLSRVTGGIFSVTKGAVGATIGGVAWIGGKSLEVTKTAVTTVPSMGIGLVKGGVSAVAGGVTAVGSAVVNKVPLTGKKKDKSD

SEQ ID NO: 850728 - protein, 256 aa, Homo sapiens
AGPCENGWACARWAREGPGLHERACASDWSRGRRRELRRRRRGRVASGATSAARGLRLHHRRHSLPAPHPERTPLEPRLPGVVPAAAAAQAASALLCAGPLTPPGPSPSAGRDPGAFETSAGVSALRGSPGISIQHQQEIMNQTDKNQQEIPSYLNDEPPEGSMKDHPQQQPGMLSRVTGGIFSVTKGAVGATIGGVAWIGGKSLEVTKTAVTTVPSMGIGLVKGGVSAVAGGVTAVGSAVVNKVPLTGKKKDKSD

SEQ ID NO: 850729 - protein, 256 aa, Homo sapiens; identical to SEQ ID NO: 850728

SEQ ID NO: 850730 - protein, 256 aa, Homo sapiens; identical to SEQ ID NO: 850728

SEQ ID NO: 850731 - protein, 116 aa, Homo sapiens; identical to SEQ ID NO: 850724

SEQ ID NO: 850732 - protein, 256 aa, Homo sapiens; identical to SEQ ID NO: 850728

SEQ ID NO: 850733 - protein, 337 aa, Homo sapiens
APAPCASLPGRAQPGVPSSAGEDPRAVTREPPQTLGGSAAGAAGSSPQLPALPGSSLSRARGPARHSQPRAMMKTLSSGNCTLSVPAKNSYRMVVLGASRVGKSSIVSRFLNGRFEDQYTPTIEDFHRKVYNIRGDMYQLDILDTSGNHPFPAMRRLSILTGDVFILVFSLDNRESFDEVKRLQKQILEVKSCLKNKTKEAAELPMVICGNKNDHGELCRQVPTTEAELLVSGDENCAYFEVSAKKNTNVDEMFYVLFSMAKLPHEMSPALHRKISVQYGDAFHPRPFCMRRVKEMDAYGMVSPFARRPSVNSDLKYIKAKVLREGQARERDKCTIQ

SEQ ID NO: 850734 - protein, 278 aa, Homo sapiens
MPASLALLQPRAMMKTLSSGNCTLSVPAKNSYRMVVLGASRVGKSSIVSRFLNGRFEDQYTPTIEDFHRKVYNIRGDMYQLDILDTSGNHPFPAMRRLSILTGDVFILVFSLDNRESFDEVKRLQKQILEVKSCLKNKTKEAAELPMVICGNKNDHGELCRQVPTTEAELLVSGDENCAYFEVSAKKNTNVDEMFYVLFSMAKLPHEMSPALHRKISVQYGDAFHPRPFCMRRVKEMDAYGMVSPFARRPSVNSDLKYIKAKVLREGQARERDKCTIQ

SEQ ID NO: 850735 - protein, 223 aa, Homo sapiens
MPEIVDTCSLASPASVCRTKHLHLRCSVDFTRRTLTGTAALTVQSQEDNLRSLVLDTKDLTIEKVVINGQEVKYALGERQSYKGSPMEISLPIALSKNQEIVIEISFETSPKSSALQWLTPEQTSGKEHPYLFSQCQAIHCRAILPCQDTPSVKLTYTAEVSVPKELVALMSAIRDGETPDPEDPSRKIYKFIQKVNNLVLMLVVGLEGGIGRLVWLKGGKVV

SEQ ID NO: 850736 - protein, 593 aa, Homo sapiens
MPEIVDTCSLASPASVCRTKHLHLRCSVDFTRRTLTGTAALTVQSQEDNLRSLVLDTKDLTIEKVVINGQEVKYALGERQSYKGSPMEISLPIALSKNQEIVIEISFETSPKSSALQWLTPEQTSGKEHPYLFSQCQAIHCRAILPCQDTPSVKLTYTAEVSVPKELVALMSAIRDGETPDPEDPSRKIYKFIQKVPIPCYLIALVVGALESRQIGPRTLVWSEKEQVEKSAYEFSETESMLKIAEDLGGPYVWGQYDLLVLPPSFPYGGMENPCLTFVTPTLLAGDKSLSNVIAHEISHSWTGNLVTNKTWDHFWLNEGHTVYLERHICGRLFGVKTFGETHPFTKLVVDLTDIDPDVAYSSVPYEKGFALLFYLEQLLGGPEIFLGFLKAYVEKFSYKSITTDDWKDFLYSYFKDKVDVLNQVDWNAWLYSPGLPPIKPNYDMTLTNACIALSQRWITAKEDDLNSFNATDLKDLSSHQLNEFLAQTLQRAPLPLGHIKRMQEVYNFNAINNSEIRFRWLRLCIQSKWEDAIPLALKMATEQGRMKFTRPLFKDLAAFDKSHDQAVRTYQEHKASMHPVTAMLVGKDLKVD

SEQ ID NO: 850737 - protein, 597 aa, Homo sapiens
MPEIVDTCSLASPASVCRTKHLHLRCSVDFTRRTLTGTAALTVQSQEDNLRSLVLDTKDLTIEKVVINGQEVKYALGERQSYKGSPMEISLPIALSKNQEIVIEISFETSPKSSALQWLTPEQTSGKEHPYLFSQCQAIHCRAILPCQDTPSVKLTYTAEVSVPKELVALMSAIRDGETPDPEDPSRKIYKFIQKVPIPCYLIALVVGALESRQIGPRTLVWSEKEQVEKSAYEFSETESMLKIAEDLGGPYVWGQYDLLVLPPSFPYGGMENPCLTFVTPTLLAGDKSLSNVIAHEISHSWTGNLVTNKTWDHFWLNEGHTVYLERHICGRLFGEKFRHFNALGGWGELQNSVKTFGETHPFTKLVVDLTDIDPDVAYSSVPYEKGFALLFYLEQLLGGPEIFLGFLKAYVEKFSYKSITTDDWKDFLYSYFKDKSPGLPPIKPNYDMTLTNACIALSQRWITAKEDDLNSFNATDLKDLSSHQLNEFLAQTLQRAPLPLGHIKRMQEVYNFNAINNSEIRFRWLRLCIQSKWEDAIPLALKMATEQGRMKFTRPLFKDLAAFDKSHDQAVRTYQEHKASMHPVTAMLVGKDLKVD

SEQ ID NO: 850738 - protein, 611 aa, Homo sapiens
MPEIVDTCSLASPASVCRTKHLHLRCSVDFTRRTLTGTAALTVQSQEDNLRSLVLDTKDLTIEKVVINGQEVKYALGERQSYKGSPMEISLPIALSKNQEIVIEISFETSPKSSALQWLTPEQTSGKEHPYLFSQCQAIHCRAILPCQDTPSVKLTYTAEVSVPKELVALMSAIRDGETPDPEDPSRKIYKFIQKVPIPCYLIALVVGALESRQIGPRTLVWSEKEQVEKSAYEFSETESMLKIAEDLGGPYVWGQYDLLVLPPSFPYGGMENPCLTFVTPTLLAGDKSLSNVIAHEISHSWTGNLVTNKTWDHFWLNEGHTVYLERHICGRLFGEKFRHFNALGGWGELQNSVKTFGETHPFTKLVVDLTDIDPDVAYSSVPYEKGFALLFYLEQLLGGPEIFLGFLKAYVEKFSYKSITTDDWKDFLYSYFKDKVDVLNQVDWNAWLYSPGLPPIKPNYDMTLTNACIALSQRWITAKEDDLNSFNATDLKDLSSHQLNEFLAQTLQRAPLPLGHIKRMQEVYNFNAINNSEIRFRWLRLCIQSKWEDAIPLALKMATEQGRMKFTRPLFKDLAAFDKSHDQAVRTYQEHKASMHPVTAMLVGKDLKVD

SEQ ID NO: 850739 - protein, 611 aa, Homo sapiens; identical to SEQ ID NO: 850738

SEQ ID NO: 850740 - protein, 532 aa, Homo sapiens
MPEIVDTCSLASPASVCRTKHLHLRCSVDFTRRTLTGTAALTVQSQEDNLRSLVLDTKDLTIEKVVINGQEVKYALGERQSYKGSPMEISLPIALSKNQEIVIEISFETSPKSSALQWLTPEQTSGKEHPYLFSQCQAIHCRAILPCQDTPSVKLTYTAEVSVPKELVALMSAIRDGETPDPEDPSRKIYKFIQKVPIPCYLIALVVGALESRQIGPRTLVWSEKEQVEKSAYEFSETESMLKIAEDLGGPYVWGQYDLLVLPPSFPYGGMENPCLTFVTPTLLAGDKSLSNVIAHEISHSWTGNLVTNKTWDHFWLNEGHTVYLERHICGRLFGEKFRHFNALGGWGELQNSVKTFGETHPFTKLVVDLTDIDPDVAYSSVPYEKGFALLFYLEQLLGGPEIFLGFLKAYVEKFSYKSITTDDWKDFLYSYFKDKVDVLNQVDWNAWLYSPGLPPIKPNYDMTLTNACIALSQRWITAKEDDLNSFNATDLKDLSSHQLNEFLAQTLQRMAAALHSIQVGGRNSFGAKDGN

SEQ ID NO: 850741 - protein, 397 aa, Homo sapiens
RSRCNRMEMLERAGGKVAYEFSETESMLKIAEDLGGPYVWGQYDLLVLPPSFPYGGMENPCLTFVTPTLLAGTKSLSHVIAHEISHSWTGNLVTNKTWDHFWLNEGHTVYLERHICGRLFGEKFRHFNALGGWGELQNSVKTFGETHPFTKLVVDLTDIDPDVAYSSVPYEKGFALLFYLEQLLGGPEIFLGFLKAYVEKFSYKSITTDDWKDFLYSYFKDKVDVLNQVDWNAWLYSPGLPPIKPNYDMTLTNACIALSQRWITAKEDDLNSFNATDLKDLSSHQLNEFLAQTLQRAPLPLGHIKRMQEVYNFNAINNSEIRFRWLRLCIQSKWEDAIPLALKMATEQGRMKFTRPLFKDLAAFDKSHDQAVRTYQEHKASMHPVTAMLVGKDLKVD

SEQ ID NO: 850742 - protein, 518 aa, Homo sapiens
MPEIVDTCSLASPASVCRTKHLHLRCSVDFTRRTLTGTAALTVQSQEDNLRSLVLDTKDLTIEKVVINGQEVKYALGERQSYKGSPMEISLPIALSKNQEIVIEISFETSPKSSALQWLTPEQTSGKEHPYLFSQCQAIHCRAILPCQDTPSVKLTYTAEVSVPKELVALMSAIRDGETPDPEDPSRKIYKFIQKVPIPCYLIALVVGALESRQIGPRTLVWSEKEQVEKSAYEFSETESMLKIAEDLGGPYVWGQYDLLVLPPSFPYGGMENPCLTFVTPTLLAGDKSLSNVIAHEISHSWTGNLVTNKTWDHFWLNEGHTVYLERHICGRLFGEKFRHFNALGGWGELQNSVKTFGETHPFTKLVVDLTDIDPDVAYSSVPYEKGFALLFYLEQLLGGPEIFLGFLKAYVEKFSYKSITTDDWKDFLYSYFKDKVDVLNQVDWNAWLYSPGLPPIKPNYDMTLTNACIALSQRWITAKEDDLNSFNATDLKDLSSHQLNEFLAQTLQRLLSSKESC

SEQ ID NO: 850743 - protein, 609 aa, Homo sapiens
MPEIVDTCSLASPASVCRTKHLHLRCSVDFTRRTLTGTAALTVQSQEDNLRSLVLDTKDLTIEKVVINGQEVKYALGERQSYKGSPMEISLPIALSKNQEIVIEISFETSPKSSALQWLTPEQTSGKEHPYLFSQCQAIHCRAILPCQDTPSVKLTYTAEVSVPKELVALMSAIRDGETPDPEDPSRKIYKFIQKVPIPCYLIALVVGALESRQIGPRTLVWSEKEQVEKSAYEFSETESMLKIAEDLGGPYVWGQYDLLVLPPSFPYGGMENPCLTFVTPTLLAGDKSLSNVIAHEISHSWTGNLVTNKTWDHFWLNEGHTVYLERHICGRLFGEKFRHFNALGGWGELQNSVKTFGETHPFTKLVVDLTDIDPDVAYSSVPYEKGFALLFYLEQLLGGPEIFLGFLKAYVEKFSYKSITTDDWKDFLYSYFKDKVDVLNQVDWNAWLYSPGLPPIKPNYDMTLTNACIALSQRWITAKEDDLNSFNATDLKDLSSHQLNDPHTPQSPPMHKKQKQKKNNNKANKKKPPRSLPPPWLRLCIQSKWEDAIPLALKMATEQGRMKFTRPLFKDLAAFDKSHDQAVRTYQEHKASMHPVTAMLVGKDLKVD

SEQ ID NO: 850744 - protein, 149 aa, Homo sapiens
MTLTNACIALSQRWITAKEDDLNSFNATDLKDLSSHQLNEFLAQTLQRAPLPLGHIKRMQEVYNFNAINNSEIRFRWLRLCIQSKWEDAIPLALKMATEQGRMKFTRPLFKDLAAFDKSHDQAVRTYQEHKASMHPVTAMLVGKDLKVD

SEQ ID NO: 850745 - protein, 611 aa, Homo sapiens; identical to SEQ ID NO: 850738

SEQ ID NO: 850746 - protein, 106 aa, Homo sapiens
MPEIVDTCSLASPASVCRTKHLHLRCSVDFTRRTLTGTAALTVQSQEDNLRSLVLDTKDLTIEKVVINGQEVKYALGERQSYKGSPMEISLPIALSNQDCYDLSLL

SEQ ID NO: 850747 - protein, 593 aa, Homo sapiens
MPEIVDTCSLASPASVCRTKHLHLRCSVDFTRRTLTGTAALTVQSQEDNLRSLVLDTKDLTIEKVVINGQEVKYALGERQSYKGSPMEISLPIALSKNQEIVIEISFETSPKSSALQWLTPEQTSGKEHPYLFSQCQAIHCRAILPCQDTPSVKLTYTAEVSVPKELVALMSAIRDGETPDPEDPSRKIYKFIQKVPIPCYLIALVVGALESRQIGPRTLVWSEKEQVEKSAYEFSETESMLKIAEDLGGPYVWGQYDLLVLPPSFPYGGMENPCLTFVTPTLLAGDKSLSNVIAHEISHSWTGNLVTNKTWDHFWLNEGHTVYLERHICGRLFGEKFRHFNALGGWGELQNSVKTFGETHPFTKLVVDLTDIDPDVAYSSVPYEKGFALLFYLEQLLGGPEIFLGFLDFPDSYFKDKVDVLNQVDWNAWLYSPGLPPIKPNYDMTLTNACIALSQRWITAKEDDLNSFNATDLKDLSSHQLNEFLAQTLQRAPLPLGHIKRMQEVYNFNAINNSEIRFRWLRLCIQSKWEDAIPLALKMATEQGRMKFTRPLFKDLAAFDKSHDQAVRTYQEHKASMHPVTAMLVGKDLKVD

SEQ ID NO: 850748 - protein, 611 aa, Homo sapiens; identical to SEQ ID NO: 850738

SEQ ID NO: 850749 - protein, 326 aa, Homo sapiens
LITLFSLVIAHEISHSWTGNLVTNKTWDHFWLNEGHTVYLERHICGRLFGEKFRHFNALGGWGELQNSVKTFGETHPFTKLVVDLTDIDPDVAYSSVPYEKGFALLFYLEQLLGGPEIFLGFLKAYVEKFSYKSITTDDWKDFLYSYFKDKVDVLNQVDWNAWLYSPGLPPIKPNYDMTLTNACIALSQRWITAKEDDLNSFNATDLKDLSSHQLNEFLAQTLQRAPLPLGHIKRMQEVYNFNAINNSEIRFRWLRLCIQSKWEDAIPLALKMATEQGRMKFTRPLFKDLAAFDKSHDQAVRTYQEHKASMHPVTAMLVGKDLKVD

SEQ ID NO: 850750 - protein, 555 aa, Homo sapiens
MPEIVDTCSLASPASVCRTKHLHLRCSVDFTRRTLTGTAALTVQSQEDNLRSLVLDTKDLTIEKVVINGQEVKYALGERQSYKGSPMEISLPIALSKNQEIVIEISFETSPKSSALQWLTPEQTSGKEHPYLFSQCQAIHCRAILPCQDTPSVKLTYTAEVSVPKELVALMSAIRDGETPDPEDPSRKIYKFIQKVPIPCYLIALVVGALESRQIGPRTLVWSEKEQVEKSAYEFSETESMLKIAEDLGGPYVWGQYDLLVLPPSFPYGGMENPCLTFVTPTLLAGDKSLSNVIAHEISHSWTGNLVTNKTWDHFWLNEGHTVYLERHICGRLFGEKFRHFNALGGWGELQNSVKTFGETHPFTKLVVDLTDIDPDVAYSSVPYEKGFALLFYLEQLLGGPEIFLGFLKAYVEKFSYKSITTDDWKDFLYSYFKDKVDVLNQVDWNAWLYSPGLPPIKPNYDMTLTNACIALSQRWITAKEDDLNSFNATDLKDLSSHQLNEFLAQTLQRAPLPLGHIKRMQEVYNFNAINNSEIRFRYIILTCLCGRKQKTKLL

SEQ ID NO: 850751 - protein, 532 aa, Homo sapiens; identical to SEQ ID NO: 850740

SEQ ID NO: 850752 - protein, 149 aa, Homo sapiens; identical to SEQ ID NO: 850744

SEQ ID NO: 850753 - protein, 156 aa, Homo sapiens
MTQTQSLSFLLGSSASLDCGFSMAPGLDLISVEWRLQHKGRGQLVYSWTAGQGQAVRKGATLEPAQLGMARDASLTLPGLTIQDEGTYICQITTSLYRAQQIIQLNIQGEARTWLSQGRGYNMSTGSVSRLGPKCKNDFLRSRLQSHNLNAITTME

SEQ ID NO: 850754 - protein, 468 aa, Homo sapiens
MGTQEGWCLLLCLALSGAAETKPHPAEGQWRAVDVVLDCFLVKDGAHRGALASSEDRARASLVLKQVPVLDDGSLEDFTDFQGGTLAQDDPPIIFEASVDLVQIPQAEALLHADCSGKEVTCEISRYFLQMTETTVKTAAWFMANVQVSGGGPSISLVMKTPRVAKNEVLWHPTLNLPLSPQGTVRTAVEFQVMTQTQSLSFLLGSSASLDCGFSMAPGLDLISVEWRLQHKGRGQLVYSWTAGQGQAVRKGATLEPAQLGMARDASLTLPGLTIQDEGTYICQITTSLYRAQQIIQLNIQASPKVRLSLANEALLPTLICDIAGYYPLDVVVTWTREELGGSPAQVSGASFSSLRQSVAGTYSISSSLTAEPGSAGATYTCQVTHISLEEPLGASTQVVPPERRTALGVIFASSLFLLALMFLGLQRRQAPTGLGLLQAERWETTSCADTQSSHLHEDRTARVSQPS

SEQ ID NO: 850755 - protein, 262 aa, Homo sapiens [sequence omitted]

SEQ ID NO: 850756 - protein, 474 aa, Homo sapiens
AILLSVKVKEKSAAEGTGKKPKGCRLPEPHPAEGQWRAVDVVLDCFLVKDGAHRGALASSEDRARASLVLKQVPVLDDGSLEDFTDFQGGTLAQDDPPIIFEASVDLVQIPQAEALLHADCSGKEVTCEISRYFLQMTETTVKTAAWFMANVQVSGGGPSISLVMKTPRVAKNEVLWHPTLNLPLSPQGTVRTAVEFQVMTQTQSLSFLLGSSASLDCGFSMAPGLDLISVEWRLQHKGRGQLVYSWTAGQGQAVRKGATLEPAQLGMARDASLTLPGLTIQDEGTYICQITTSLYRAQQIIQLNIQASPKVRLSLANEALLPTLICDIAGYYPLDVVVTWTREELGGSPAQVSGASFSSLRQSVAGTYSISSSLTAEPGSAGATYTCQVTHISLEEPLGASTQVVPPERRTALGVIFASSLFLLALMFLGLQRRQAPTGLGLLQAERWETTSCADTQSSHLHEDRTARVSQPS

SEQ ID NO: 850757 - protein, 185 aa, Homo sapiens
MGTQEGWCLLLCLALSGAAETMDLVQIPQAEALLHADCSGKEVTCEISRYFLQMTETTVKTAAWFMANVQVSGGGPSISLVMKTPRVAKNEVLWHPTLNLPLSPQGTVRTAVEFQVMTQTQSLSFLLGSSASLDCGFSMAPGLDLISVEWRLQHKGRGRGDLHLPDHHLSVPSSADHPAQHPSFP

SEQ ID NO: 850758 - protein, 128 aa, Homo sapiens
HTRSFHTFCLLERLKAGSPAHPQADLKRHETTRKKRHPSPSPHSYSNPNNNQASLMVGICIFCLCSEYMTLVNMPHAFGGSTTVVITLYKYEIRVRKKRQRGDDRHTVETPHRLMANRRTGCGKLSFI

SEQ ID NO: 850759 - protein, 154 aa, Homo sapiens
TTLQLSSFLSEIPVPKSSFLAAPGSEPHPAEGQWRAVDVVLDCFLVKDGAHRGALTAEPGSAGATYTCQVTHISLEEPLGASTQVVPPERRTALGVIFASSLFLLALMFLGLQRRQAPTGLGLLQAERWETTSCADTQSSHLHEDRTARVSQPS

SEQ ID NO: 850760 - protein, 104 aa, Homo sapiens
TWTREELGGSPAQVSGASFSSLRQSVAGTYSISSSLTAEPGSAGATYTCQVTHISLEEPLGASTQVVPPGTGSVLLFPTSTLGLMALLPQLIYGLVLLPIHFVR

SEQ ID NO: 850761 - protein, 468 aa, Homo sapiens; identical to SEQ ID NO: 850754

SEQ ID NO: 850762 - protein, 104 aa, Homo sapiens [sequence omitted]

SEQ ID NO: 850763 - protein, 472 aa, Homo sapiens
PPCSSPASSLKSQSQNPVSWPPPGSEPHPAEGQWRAVDVVLDCFLVKDGAHRGALASSEDRARASLVLKQVPVLDDGSLEDFTDFQGGTLAQDDPPIIFEASVDLVQIPQAEALLHADCSGKEVTCEISRYFLQMTETTVKTAAWFMANVQVSGGGPSISLVMKTPRVAKNEALWHPTLNLPLSPQGTVRTAVEFQVMTQTQSLSFLLGSSASLDCGFSMAPGLDLISVEWRLQHKGRGQLVYSWTAGQGQAVRKGATLEPAQLGMARDASLTLPGLTIQDEGTYICQITTSLYRAQQIIQLNIQASPKVRLSLANEALLPTLICDIAGYYPLDVVVTWTREELGGSPAQVSGASFSSLRQSVAGTYSISSSLTAEPGSAGATYTCQVTHISLEEPLGASTQVVPPERRTALGVIFASSLFLLALMFLGLQRRQAPTGLGLLQAERWETTSCADTQSSHLHEDRTARVSQPS

SEQ ID NO: 850764 - protein, 275 aa, Homo sapiens [sequence omitted]

SEQ ID NO: 850765 - protein, 468 aa, Homo sapiens; identical to SEQ ID NO: 850754

SEQ ID NO: 850766 - protein, 89 aa, Homo sapiens
MTPQLEGGGRKQVWSSFLGKAVLTPAFVCREPHPAEGQWRAVDVVLDCFLVKDGAHRGALASSEDRARASLVLKQVPVLDDGSLEDFTD

SEQ ID NO: 850767 - protein, 333 aa, Homo sapiens
MIWRSRAGAELFSLMALWEWIALSLHCWVLAVAAVSDQHATSPFDWLLSDKGPFHRSQEYTDFVDRSRQGFSTRYKIYREFGRWKVNNLAVERRNFLGSPLPLAPEFFRNIRLLGRRPTLQQITENLIKKYGTHFLLSATLGGEESLTIFVDKRKLSKRAEGSDSTTNSSSVTLETLHQLAASYFIDRDSTLRRLHHIQIASTAIKVTETRTGPLGCSNYDNLDSVSSVLVQSPENKIQLQGLQVLLPDYLQERFVQAALSYIACNSEGEFICKENDCWCHCGPKFPECNCPSMDIQAMEENLLRITETWKAYNSDFEESGLKFKSCYTLHRQ

SEQ ID NO: 850768 - protein, 597 aa, Homo sapiens
MIWRSRAGAELFSLMALWEWIALSLHCWVLAVAAVSDQHATSPFDWLLSDKGPFHRSQEYTDFVDRSRQGFSTRYKIYREFGRWKVNNLAVERRNFLGSPLPLAPEFFRNIRLLGRRPTLQQITENLIKKYGTHFLLSATLGGEESLTIFVDKRKLSKRAEGSDSTTNSSSVTLETLHQLAASYFIDRDSTLRRLHHIQIASTAIKVTETRTGPLGCSNYDNLDSVSSVLVQSPENKIQLQGLQVLLPDYLQERFVQAALSYIACNSEGEFICKENDCWCHCGPKFPECNCPSMDIQAMEENLLRITETWKAYNSDFEESDEFKLFMKRLPMNYFLNTSTIMHLWTMDSNFQRRYEQLENSMKQLFLKAQKIVHKLFSLSKRCHKQPLISLPRQRTSTYWLTRIQSFLYCNENGLLGSFSEETHSCTCPNDQVVCTAFLPCTVGDASACLTCAPDNRTRCGTCNTGYMLSQGLCKPEVAESTDHYIGFETDLQDLEMKYLLQKTDRRIEVHAIFISNDMRLNSWFDPSWRKRMLLTLKSNKYKSSLVHMILGLSLQICLTKNSTLEPVLAVYVNPFGGSHSESWFMPVNENSFPDWE

SEQ ID NO: 850769 - protein, 597 aa, Homo sapiens; identical to SEQ ID NO: 850768

SEQ ID NO: 850770 - protein, 78 aa, Homo sapiens
ESANYFPRLHATECKRVTQVLWLGFSHRLQLKTNNINNMNQDELPVSAGARVTERDLRSLEGAVARFLVVEPCTQREW

SEQ ID NO: 850771 - protein, 753 aa, Homo sapiens
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRLLAQRQQHSFGLHGVACVGTEAHLSLCSLEFYRANDTARCPGGGPAVVSCVPGPVYAASSGQKKQQQSKPQGEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANHGLQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 850772 - protein, 624 aa, Homo sapiens
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRPVSVYKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 850773 - protein, 654 aa, Homo sapiens
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRPVSVYKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIAPLAPNGRGLRLPLPQELTKKPMSATALIRPCTMDVELSSRSFHPPSEASCQYL

SEQ ID NO: 850774 - protein, 324 aa, Homo sapiens
WEGKGSRGCCLKACVLGRGLRNESLWPQMLDPGPYRNICICPQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 850775 - protein, 70 aa, Homo sapiens
SHHQAADQPYREKWTERKEGVQSLVQGHMHTLPIPISHCSLSLTVCRGAQDDFMDEYTMLNIGKAWFSKL

SEQ ID NO: 850776 - protein, 713 aa, Homo sapiens
MLLATLLLLLLGGALAHPDRIIFPNHACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGGPGARRRQRGRLMRRLVRRLRRWGLLPRTNTPARASEARSQVTPSAAPLEALDGGTGPAREGGAVGGQDGEQAPPLPIKAPLPSASTSPAPTTVPEAPGPLPSLPLEPSLLSGVVQALRGRLLPSLGPPGPTRSPPGPHTAVLALEDEDDVLLVPLAEPGVWVAEAEDEPLLT

SEQ ID NO: 850777 - protein, 713 aa, Homo sapiens; identical to SEQ ID NO: 850776

SEQ ID NO: 850778 - protein, 683 aa, Homo sapiens
PESSRLLRSLTHFSNGKAVTVETLSGQAVVSYHTVAWSNGRGFNATYHVRGYCLPWDRPCGLGSGLGAGEGLCERCYSGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGGPGARRRQRGRLMRRLVRRLRRWGLLPRTNTPARASEARSQVTPSAAPLEALDGGTGPAREGGAVGGQDGEQAPPLPIKAPLPSASTSPAPTTVPEAPGPLPSLPLEPSLLSGVVQALRGRLLPSLGPPGPTRSPPGPHTAVLALEDEDDVLLVPLAEPGVWVAEAEDEPLLT

SEQ ID NO: 850779 - protein, 557 aa, Homo sapiens
GLLWGLLLSWIYTPSLSLPPPVLQGDIARQGGDGSCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGGPGARRRQRGRLMRRLVRRLRRWGLLPRTNTPARASEARSQVTPSAAPLEALDGGTGPAREGGAVGGQDGEQAPPLPIKAPLPSASTSPAPTTVPEAPGPLPSLPLEPSLLSGVVQALRGRLLPSLGPPGPTRSPPGPHTAVLALEDEDDVLLVPLAEPGVWVAEAEDEPLLT

SEQ ID NO: 850780 - protein, 329 aa, Homo sapiens
EAGLCSYRRPRKCPPWGEAPMISLSVVSCKGQVQILKAVSREEGPQMTFGKAMAQLQLAWPGCGSGRTVQAEVVYSGRELPVTEQSSFLLSIFAPLSRMEAEIVQQQAPPSYGQLIAQGAIPPVEDFPTENPNDNSVLGNLRSLLQILRQDMTPGGGPGARRRQRGRLMRRLVRRLRRWGLLPRTNTPARASEARSQVTPSAAPLEALDGGTGPAREGGAVGGQDGEQAPPLPIKAPLPSASTSPAPTTVPEAPGPLPSLPLEPSLLSGVVQALRGRLLPSLGPPGPTRSPPGPHTAVLALEDEDDVLLVPLAEPGVWVAEAEDEPLLT

SEQ ID NO: 850781 - protein, 114 aa, Homo sapiens
PPRLLQPLGGRGYRLGKGRGAGPSHLFPSPAPTTVPEAPGPLPSLPLEPSLLSGVVQALRGRLLPSLGPPGPTRSPPGPHTAVLALEDEDDVLLVPLAEPGVWVAEAEDEPLLT

SEQ ID NO: 850782 - protein, 713 aa, Homo sapiens; identical to SEQ ID NO: 850776

SEQ ID NO: 850783 - protein, 713 aa, Homo sapiens; identical to SEQ ID NO: 850776

SEQ ID NO: 850784 - protein, 532 aa, Homo sapiens
MLLATLLLLLLGGALAHPDRIIFPNHACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYSIFAPLSRMEAEIVQQQAPPSYGQLIAQGAIPPVEDFPTENPNDDGGHLGHLLESYPS

SEQ ID NO: 850785 - protein, 299 aa, Homo sapiens
MLLATLLLLLLGGALAHPDRIIFPNHACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHATTIWVAVFKK

SEQ ID NO: 850786 - protein, 713 aa, Homo sapiens; identical to SEQ ID NO: 850776

SEQ ID NO: 850787 - protein, 747 aa, Homo sapiens
MWRERAKLEGCNSRLCVGRGRYSAPPCRAQTFGNLKPPSGRGRVGCKGAVYYPCPTFLSPACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGGPGARRRQRGRLMRRLVRRLRRWGLLPRTNTPARASEARSQVTPSAAPLEALDGGTGPAREGGAVGGQDGEQAPPLPIKAPLPSASTSPAPTTVPEAPGPLPSLPLEPSLLSGVVQALRGRLLPSLGPPGPTRSPPGPHTAVLALEDEDDVLLVPLAEPGVWVAEAEDEPLLT

SEQ ID NO: 850788 - protein, 713 aa, Homo sapiens; identical to SEQ ID NO: 850776

SEQ ID NO: 850789 - protein, 231 aa, Homo sapiens
MEAEIVQQQAPPSYGQLIAQGAIPPVEDFPTENPNDNSVLGNLRSLLQILRQDMTPGGGPGARRRQRGRLMRRLVRRLRRWGLLPRTNTPARASEARSQVTPSAAPLEALDGGTGPAREGGAVGGQDGEQAPPLPIKAPLPSASTSPAPTTVPEAPGPLPSLPLEPSLLSGVVQALRGRLLPSLGPPGPTRSPPGPHTAVLALEDEDDVLLVPLAEPGVWVAEAEDEPLLT

SEQ ID NO: 850790 - protein, 578 aa, Homo sapiens
MLLATLLLLLLGGALAHPDRIIFPNHACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGGPGARRRQRGRLMRRLQSWPWKMRTMCYWCHWLSRGCG

SEQ ID NO: 850791 - protein, 556 aa, Homo sapiens
MLLATLLLLLLGGALAHPDRIIFPNHACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGGPGARRRQRGRLMRRL

SEQ ID NO: 850792 - protein, 713 aa, Homo sapiens; identical to SEQ ID NO: 850776

SEQ ID NO: 850793 - protein, 485 aa, Homo sapiens
MLLATLLLLLLGGALAHPDRIIFPNHACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYRSVGVGLAVEE

SEQ ID NO: 850794 - protein, 111 aa, Homo sapiens
TTALQPDRARLHLKKKERKANSAADSGYRANEQQLPLHAVTAGIIGICYIFNTSYLYHATMASVANTYRPVYSFLSLLSNKLLVFSLLINDLRLPGIKTTLPSLLCSWPGN

SEQ ID NO: 850795 - protein, 158 aa, Homo sapiens
MKFGCLSFRQPYAGFVLNGIKTVETRWRPLLSSQRNCTIAVHIAHRDWEGDAWRELLVERLGMTPAQIQALLRKGEKFGRGVIAGLVDIGETLQCPEDLTPDEVVELENQAVLTNLKQKYLTVISNPRWLLEPIPRKGGKDVFQVDIPEHLIPLGHEV

SEQ ID NO: 850796 - protein, 158 aa, Homo sapiens; identical to SEQ ID NO: 850795

SEQ ID NO: 850797 - protein, 158 aa, Homo sapiens; identical to SEQ ID NO: 850795

SEQ ID NO: 850798 - protein, 158 aa, Homo sapiens; identical to SEQ ID NO: 850795

SEQ ID NO: 850799 - protein, 158 aa, Homo sapiens; identical to SEQ ID NO: 850795

SEQ ID NO: 850800 - protein, 158 aa, Homo sapiens; identical to SEQ ID NO: 850795

SEQ ID NO: 850801 - protein, 158 aa, Homo sapiens; identical to SEQ ID NO: 850795

SEQ ID NO: 850802 - protein, 205 aa, Homo sapiens
MIRHSLLWTVKQLSPPYSGPPQRLHGMDLSQPNPSPFRYGRPGALAKMKFGCLSFRQPYAGFVLNGIKTVETRWRPLLSSQRNCTIAVHIAHRDWEGDAWRELLVERLGMTPAQIQALLRKGEKFGRGVIAGLVDIGETLQCPEDLTPDEVVELENQAVLTNLKQKYLTVISNPRWLLEPIPRKGGKDVFQVDIPEHLIPLGHEV

SEQ ID NO: 850803 - protein, 34 aa, Homo sapiens
MLGCKNAAQHGEMIFCPAGWCTLWSLTQTGAEGP

SEQ ID NO: 850804 - protein, 34 aa, Homo sapiens; identical to SEQ ID NO: 850803

SEQ ID NO: 850805 - protein, 151 aa, Homo sapiens
MKFGCLSFRQPYAGFVLNGIKTVETRWRPLLSSQRNCTIAVHIAHRDWEGDAWRELLVERLGMTPAQIQALLRKGEKFGRGVIAGLVDIGETLQCPEDLTPDEVVELENQAVLTNLKQKYLTVISNPRWLLEPIPRKGGKDVFQECSRETS

SEQ ID NO: 850806 - protein, 158 aa, Homo sapiens; identical to SEQ ID NO: 850795

SEQ ID NO: 850807 - protein, 158 aa, Homo sapiens; identical to SEQ ID NO: 850795

SEQ ID NO: 850808 - protein, 146 aa, Homo sapiens
MKFGCLSFRQPYAGFVLNGIKTVETRWRPLLSSQRNCTIAVHIAHRDWEGDAWRELLVERLGMTPAQIQALLRKGEKFGRGVIAGLVDIGETLQCPEDLTPDEVVELENQAVLTNLKQKYLTVISNPRWLLEPIPRKGGKDVFQNP

SEQ ID NO: 850809 - protein, 179 aa, Homo sapiens
MDLSQPNPSPFRYGRPGALAKMKFGCLSFRQPYAGFVLNGIKTVETRWRPLLSSQRNCTIAVHIAHRDWEGDAWRELLVERLGMTPAQIQALLRKGEKFGRGVIAGLVDIGETLQCPEDLTPDEVVELENQAVLTNLKQKYLTVISNPRWLLEPIPRKGGKDVFQVDIPEHLIPLGHEV

SEQ ID NO: 850810 - protein, 155 aa, Homo sapiens
MKFGCLSFRQPYAGFVLNGIKTVETRWRPLLSSQRNCTIAVHIAHRDWEGDAWRELLVERLGMTPAQIQALLRKGEKFGRGVIAGLVDIGETLQCPEDLTPDEVVVLDISDRRKQETIKATGGPGRLLKMKFGCLSFRQPYAGFVLNGIKTVETR

SEQ ID NO: 850811 - protein, 140 aa, Homo sapiens
ASYEGSGGGGGRHLGSGRNGGGSVNAPPAFESFLLFEGEKKITINKDTKVPNACLFTINKEDHTLGNIIKSQCDLKDPQVLFAGYKVPHPLEHKIIIRVQTTPDYSPQEAFTNAITDLISELSLLEERFRAIKDKQEGIE

SEQ ID NO: 850812 - protein, 140 aa, Homo sapiens
ASYEGSGGGGGRHLGSGRNGGGSVNAPPAFESFLLFEGEKKITINKDTKVPNACLFTINKEDHTLGNIIKSQCDLKDPQVLFAGYKVPHPLEHKIIIRVQTTPDYSPQEAFTNAITDLISELSLLEERFRTCLLPLRLLP

SEQ ID NO: 850813 - protein, 118 aa, Homo sapiens
PPQPPKVLGLQARATTPGREETGFRLRVGGGEPLLLICGLCVFLGSPLTRTPRYPMPVYSPSTKKTTHWETSLNRKFPVTGSQGLCLMGPSGQSTSSKSSSVSLSYRKSFWGLALGIL

SEQ ID NO: 850814 - protein, 183 aa, Homo sapiens
ASYEGSGGGGGRHLGSGRNGGGSVNAPPAFESFLLFEGEKKITINKDTKVPNACLFTINKEDHTLGNIIKSQCDLKDPQVLFAGYKVPHPLEHKIIIRVQTTPDYSPQEAFTNAITDLISELSLLEERFRVRAGPGGADGVGWTLARVPRPGTALACFFGGPGGEAAVMEEQGLPPQAPGHVD

SEQ ID NO: 850815 - protein, 187 aa, Homo sapiens
PPQPPKVLGLQARATTPGREETGFETQGGRRGAPAPHLWPLCLPRITINKDTKVPNACLFTINKEDHTLGNIIKSQCDLKDPQVLFAGYKVPHPLEHKIIIRVQTTPDYSPQEAFTNAITDLISELSLLEERFRVRAGPGGADGVGWTLARVPRPGTALACFFGGPGGEAAVMEEQGLPPQAPGHVD

SEQ ID NO: 850816 - protein, 140 aa, Homo sapiens
ASYEGSGGGGGRHLGSGRNGGGSVNAPPAFESFLLFEGEKKITINKDTKVPNACLFTINKEDHTLGNIIKSQCDLKDPQVLFAGYKVPHPLEHKIIIRVQTTPDYSPQEAFTNAITDLISELSLLEERFRESLAHRKGTN

SEQ ID NO: 850817 - protein, 140 aa, Homo sapiens; identical to SEQ ID NO: 850812

SEQ ID NO: 850818 - protein, 168 aa, Homo sapiens
ASYEGSGGGGGRHLGSGRNGGGSVNAPPAFESFLLFEGEKKITINKDTKVPNACLFTINKEDHTLGNIIKSQCDLKDPQVLFAGYKVPHPLEHKIIIRVQTTPDYSPQEAFTNAITDLISELSLLEERFRSPHLMVPTLHHPPPPGGGTPRCSAGDSAHSGGAVDGWS

SEQ ID NO: 850819 - protein, 183 aa, Homo sapiens; identical to SEQ ID NO: 850814

SEQ ID NO: 850820 - protein, 139 aa, Homo sapiens
MFFCSDLAATQLGHEARPSHCLSLDLRQCDLKDPQVLFAGYKVPHPLEHKIIIRVQTTPDYSPQEAFTNAITDLISELSLLEERFRVRAGPGGADGVGWTLARVPRPGTALACFFGGPGGEAAVMEEQGLPPQAPGHVD

SEQ ID NO: 850821 - protein, 540 aa, Homo sapiens
MVRTDGHTLSEKRNYQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNSMSGFGMNRNQAFGMNNSLSSNIFNGTDGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELFNRDWRYHKEERVWITRAPGMEPTMKTNTYERGTYYFFDCLNWRKVAKEFHLEYDKLEERPHLPSTFNYNPAQQAF

SEQ ID NO: 850822 - protein, 540 aa, Homo sapiens; identical to SEQ ID NO: 850821

SEQ ID NO: 850823 - protein, 540 aa, Homo sapiens; identical to SEQ ID NO: 850821

SEQ ID NO: 850824 - protein, 251 aa, Homo sapiens
MVRTDGHTLSEKRNYQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNSMSGFGMNRNQAFGMNNSLSSNIFNGTDGSENVTGLDLSDFPHYQAPAIKIQHQVMMTVNLI

SEQ ID NO: 850825 - protein, 433 aa, Homo sapiens
MVRTDGHTLSEKRNYQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNSMSGFGMNRNQAFGMNNSLSSNIFNGTDGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIGRRIYLCLDLLKRNLQLRIS

SEQ ID NO: 850826 - protein, 531 aa, Homo sapiens
MLKEVAQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNSMSGFGMNRNQAFGMNNSLSSNIFNGTDGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELFNRDWRYHKEERVWITRAPGMEPTMKTNTYERGTYYFFDCLNWRKVAKEFHLEYDKLEERPHLPSTFNYNPAQQAF

SEQ ID NO: 850827 - protein, 520 aa, Homo sapiens
MFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNSMSGFGMNRNQAFGMNNSLSSNIFNGTDGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELFNRDWRYHKEERVWITRAPGMEPTMKTNTYERGTYYFFDCLNWRKVAKEFHLEYDKLEERPHLPSTFNYNPAQQAF

SEQ ID NO: 850828 - protein, 455 aa, Homo sapiens
MRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNSMSGFGMNRNQAFGMNNSLSSNIFNGTDGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELFNRDWRYHKEERVWITRAPGMEPTMKTNTYERGTYYFFDCLNWRKVAKEFHLEYDKLEERPHLPSTFNYNPAQQAF

SEQ ID NO: 850829 - protein, 403 aa, Homo sapiens
MVRTDGHTLSEKRNYQVTNSMFGASRKKFVEGVDSDYHDENMYYSQSSMFPHRSEKDMLASPSTSGQLSQFGASLYGQQNGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELFNRDWRYHKEERVWITRAPGMEPTMKTNTYERGTYYFFDCLNWRKVAKEFHLEYDKLEERPHLPSTFNYNPAQQAF

SEQ ID NO: 850830 - protein, 394 aa, Homo sapiens
MLKEVAQVTNSMFGASRKKFVEGVDSDYHDENMYYSQSSMFPHRSEKDMLASPSTSGQLSQFGASLYGQQNGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELFNRDWRYHKEERVWITRAPGMEPTMKTNTYERGTYYFFDCLNWRKVAKEFHLEYDKLEERPHLPSTFNYNPAQQAF

SEQ ID NO: 850831 - protein, 520 aa, Homo sapiens
MVRTDGHTLSEKRNYQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNSMSGFGMNRNQAFGMNNSLSSNIFNGTDGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELFNRDWRYHKEERVWITRAPGMEPTMKTNTYERGTYYFFDCLNWRKVAKSSIWNMTN

SEQ ID NO: 850832 - protein, 521 aa, Homo sapiens
MVRTDGHTLSEKRNYQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNSMSGFGMNRNQAFGMNNSLSSNIFNGTDGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELFNRDWRYHKEERVWITRAPGMEPTMKTNTYERGTYYFFDCLNWRKVAKVYFFPCANV

SEQ ID NO: 850833 - protein, 134 aa, Homo sapiens
AAPTTTKLAAVRTEYLTNIHIRDKLAAIKLGRYGEDLLFYLYYMNGGDVLQLLAAVELFNRDWRYHKEERVWITRAPGMEPTMKTNTYERGTYYFFDCLNWRKVAKEFHLEYDKLEERPHLPSTFNYNPAQQAF

SEQ ID NO: 850834 - protein, 540 aa, Homo sapiens; identical to SEQ ID NO: 850821

SEQ ID NO: 850835 - protein, 475 aa, Homo sapiens
MVRTDGHTLSEKRNYQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNSMSGFGMNRNQAFGMNNSLSSNIFNGTDGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELYVQSILITFVL

SEQ ID NO: 850836 - protein, 472 aa, Homo sapiens
MVRTDGHTLSEKRNYQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNSMSGFGMNRNQAFGMNNSLSSNIFNGTDGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELSSIWNMTN

SEQ ID NO: 850837 - protein, 455 aa, Homo sapiens; identical to SEQ ID NO: 850828

SEQ ID NO: 850838 - protein, 479 aa, Homo sapiens
MVRTDGHTLSEKRNYQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSSMSGFGMNRNQAFGMNNSLSSNIFNGTDGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELFNRDWRYHKEERVWITRAPGMEPTMKTNTYERGTYYFFDCLNWRKVAKEFHLEYDKLEERPHLPSTFNYNPAQQAF

SEQ ID NO: 850839 - protein, 280 aa, Homo sapiens
MVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELFNRDWRYHKEERVWITRAPGMEPTMKTNTYERGTYYFFDCLNWRKVAKEFHLEYDKLEERPHLPSTFNYNPAQQAF

SEQ ID NO: 850840 - protein, 475 aa, Homo sapiens; identical to SEQ ID NO: 850835

SEQ ID NO: 850841 - protein, 168 aa, Homo sapiens
DPGGLQGGDLSTLGLNLNSPENLYPKFASPWASSPCRPQDIDFHVPSEYLTNIHIRDKLAAIKLGRYGEDLLFYLYYMNGGDVLQLLAAVELFNRDWRYHKEERVWITRAPGMEPTMKTNTYERGTYYFFDCLNWRKVAKEFHLEYDKLEERPHLPSTFNYNPAQQAF

SEQ ID NO: 850842 - protein, 388 aa, Homo sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMTQSAVKSLKRPLEATFDLGIPQAVLPPLPKRPALEKTNGATAVFNTGIFQYQQALANMQLQQHTAFLPPVPMVHGATPATVSAATTSATSVPFAATATANQIPIISAEHLTSHKYVTQM

SEQ ID NO: 850843 - protein, 388 aa, Homo sapiens; identical to SEQ ID NO: 850842

SEQ ID NO: 850844 - protein, 388 aa, Homo sapiens; identical to SEQ ID NO: 850842

SEQ ID NO: 850845 - protein, 382 aa, Homo sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPGSILCMTPATSVVPMVHGATPATVSAATTSATSVPFAATATANQIPIISAEHLTSHKYVTQM

SEQ ID NO: 850846 - protein, 340 aa, Homo sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMFPWCTVLRQPLCPQQQHLPQVFPSLQQPQPTSPILDASTLLGATSCPAAAGKMIPIISAEHLTSHKYVTQM

SEQ ID NO: 850847 - protein, 382 aa, Homo sapiens; identical to SEQ ID NO: 850845

SEQ ID NO: 850848 - protein, 86 aa, Homo sapiens
RKCSFRCNSHSHPDTHTSLNNHAKEERTVCLVRVKDEVISHIVYIVKQHTQKFLSHKTSTYCMLTRRKDNIFRKSTAHCCLYTLYI

SEQ ID NO: 850849 - protein, 302 aa, Homo sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPVPMVHGATPATVSAATTSATSVPFAATATANQIPIISAEHLTSHKYVTQM

SEQ ID NO: 850850 - protein, 302 aa, Homo sapiens; identical to SEQ ID NO: 850849

SEQ ID NO: 850851 - protein, 382 aa, Homo sapiens; identical to SEQ ID NO: 850845

SEQ ID NO: 850852 - protein, 382 aa, Homo sapiens; identical to SEQ ID NO: 850845

SEQ ID NO: 850853 - protein, 370 aa, Homo sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPVPMVHGATPATVSAATTSATSVPFAATATANQIPIISAEHLTSHKYVTQM

SEQ ID NO: 850854 - protein, 388 aa, Homo sapiens; identical to SEQ ID NO: 850842

SEQ ID NO: 850855 - protein, 302 aa, Homo sapiens; identical to SEQ ID NO: 850849

SEQ ID NO: 850856 - protein, 314 aa, Homo sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPGSILCMTPATSVVPMVHGATPATVSAATTSATSVPFAATATANQIPIISAEHLTSHKYVTQM

SEQ ID NO: 850857 - protein, 382 aa, Homo sapiens; identical to SEQ ID NO: 850845

SEQ ID NO: 850858 - protein, 330 aa, Homo sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPDTHNICRTSD

SEQ ID NO: 850859 - protein, 288 aa, Homo sapiens [sequence omitted]

SEQ ID NO: 850860 - protein, 302 aa, Homo sapiens; identical to SEQ ID NO: 850849

SEQ ID NO: 850861 - protein, 302 aa, Homo sapiens; identical to SEQ ID NO: 850849

SEQ ID NO: 850862 - protein, 382 aa, Homo sapiens; identical to SEQ ID NO: 850845

SEQ ID NO: 850863 - protein, 382 aa, Homo sapiens; identical to SEQ ID NO: 850845

SEQ ID NO: 850864 - protein, 382 aa, Homo sapiens; identical to SEQ ID NO: 850845

SEQ ID NO: 850865 - protein, 73 aa, Homo sapiens
MELPKLKLSGVVRLSSYSSPTLQSVLGSGTNGRVPVLRPLKCIPASKKTDPQKDLKPAPQQCRLPTIVRKGGR

SEQ ID NO: 850866 - protein, 73 aa, Homo sapiens; identical to SEQ ID NO: 850865

SEQ ID NO: 850867 - protein, 462 aa, Homo sapiens
HAQATAHGVQGLTVARVTGTQHGGGISNALLRGTTTEILVRDPASDYKAIGKIGEGTFSEVMKMQSLRDGNYYACKQMKQRFESIEQVNNLREIQALRRLNPHPNILMLHEVVFDRKSGSLALICELMDMNIYELIRGRRYPLSEKKIMHYMYQLCKSLDHIHRNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRKTEKRALGSHRKAGFPEHPVAPEPLSNSCQISKEGRKQKQSLKQEEDRPKRRGPAYVMELPKLKLSGVVRLSSYSSPTLQSVLGSGTNGRVPVLRPLKCIPASKKTDPQKDLKPAPQQCRLPTIVRKGGR

SEQ ID NO: 850868 - protein, 236 aa, Homo sapiens
MKNYKAIGKIGEGTFSEVMKMQSLRDGNYYACKQMKQRFESIEQVNNLREIQALRRLNPHPNILMLHEVVFDRKSGSLALICELMDMNIYELIRGRRYPLSEKKIMHYMYQLCKSLDHIHRNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKHESYEF

SEQ ID NO: 850869 - protein, 262 aa, Homo sapiens
MKNYKAIGKIGEGTFSEVMKMQSLRDGNYYACKQMKQRFESDRKSGSLALICELMDMNIYELIRGRRYPLSEKKIMHYMYQLCKSLDHIHRNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRNSP

SEQ ID NO: 850870 - protein, 262 aa, Homo sapiens; identical to SEQ ID NO: 850869

SEQ ID NO: 850871 - protein, 335 aa, Homo sapiens
MDMNIYELIRGRRYPLSEKKIMHYMYQLCKSLDHIHRNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRKTEKRALGSHRKAGFPEHPVAPEPLSNSCQISKEGRKQKQSLKQEEDRPKRRGPAYVMELPKLKLSGVVRLSSYSSPTLQSVLGSGTNGRVPVLRPLKCIPASKKTDPQKDLKPAPQQCRLPTIVRKGGR

SEQ ID NO: 850872 - protein, 475 aa, Homo sapiens
MKNYKAIGKIGEGTFSEVMKMQSLRDGNYYACKQMKQRFESIEQVNNLREIQALRRLNPHPNILMLHEVVFDRKSGSLALICELMDMNIYELIRGRRYPLSEKKIMHYMYQLCKSLDHIHRNGIFHRDVKPENILIKVVKNGLFKNAINITDCTWKKIIESTIFTPQTKMNPIQTAVQTFYEGNVAEAGFELQQDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRKTEKRALGSHRKAGFPEHPVAPEPLSNSCQISKEGRKQKQSLKQEEDRPKRRGPAYVMELPKLKLSGVVRLSSYSSPTLQSVLGSGTNGRVPVLRPLKCIPASKKTDPQKDLKPAPQQCRLPTIVRKGGR

SEQ ID NO: 850873 - protein, 311 aa, Homo sapiens [sequence omitted]

SEQ ID NO: 850874 - protein, 122 aa, Homo sapiens
MRESPPTRPCSTPTSKNRETVPKARGGPSQETRTGLCHGTAQTKAFGSGQTVVLLQPHAAVRAWIWNKWKSAGAETLEVHPCEQEGSAEPASLTALLFDPAQAATEFCVCNFSLTDRSAEGP

SEQ ID NO: 850875 - protein, 262 aa, Homo sapiens; identical to SEQ ID NO: 850869

SEQ ID NO: 850876 - protein, 389 aa, Homo sapiens
MKNYKAIGKIGEGTFSEVMKMQSLRDGNYYACKQMKQRFESDRKSGSLALICELMDMNIYELIRGRRYPLSEKKIMHYMYQLCKSLDHIHRNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRKTEKRALGSHRKAGFPEHPVAPEPLSNSCQISKEGRKQKQSLKQEEDRPKRRGPAYVMELPKLKLSGVVRLSSYSSPTLQSVLGSGTNGRVPVLRPLKCIPASKKTDPQKDLKPAPQQCRLPTIVRKGGR

SEQ ID NO: 850877 - protein, 299 aa, Homo sapiens
MKNYKAIGKIGEGTFSEVMKMQSLRDGNYYACKQMKQRFESDRKSGSLALICELMDMNIYELIRGRRYPLSEKKIMHYMYQLCKSLDHIHRNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRTQNGSEDEASAVLLPIQTRSSLNPLLSTCMLPGRSVTLLV

SEQ ID NO: 850878 - protein, 263 aa, Homo sapiens
MKNYKAIGKIGEGTFSEVMKMQSLRDGNYYACKQMKQRFESDRKSGSLALICELMDMNIYELIRGRRYPLSEKKIMHYMYQLCKSLDHIHRNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRRLTP

SEQ ID NO: 850879 - protein, 419 aa, Homo sapiens
MKNYKAIGKIGEGTFSEVMKMQSLRDGNYYACKQMKQRFESIEQVNNLREIQALRRLNPHPNILMLHEVVFDRKSGSLALICELMDMNIYELIRGRRYPLSEKKIMHYMYQLCKSLDHIHRNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRKTEKRALGSHRKAGFPEHPVAPEPLSNSCQISKEGRKQKQSLKQEEDRPKRRGPAYVMELPKLKLSGVVRLSSYSSPTLQSVLGSGTNGRVPVLRPLKCIPASKKTDPQKDLKPAPQQCRLPTIVRKGGR

SEQ ID NO: 850880 - protein, 389 aa, Homo sapiens; identical to SEQ ID NO: 850876

SEQ ID NO: 850881 - protein, 231 aa, Homo sapiens
MKNYKAIGKIGEGTFSEVMKMQSLRDGNYYACKQMKQRFESIEQVNNLREIQALRRLNPHPNILMLHEVVFDRKSGSLALICELMDMNIYELIRGRRYPLSEKKIMHYMYQLCKSLDHIHRNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKQ

SEQ ID NO: 850882 - protein, 231 aa, Homo sapiens; identical to SEQ ID NO: 850881

SEQ ID NO: 850883 - protein, 237 aa, Homo sapiens
MKNYKAIGKIGEGTFSEVMKMQSLRDGNYYACKQMKQRFESIEQVNNLREIQALRRLNPHPNILMLHEVVFDRKSGSLALICELMDMNIYELIRGRRYPLSEKKIMHYMYQLCKSLDHIHRNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKQDQEYLY

SEQ ID NO: 850884 - protein, 457 aa, Homo sapiens
MKNYKAIGKIGEGTFSEVMKMQSLRDGNYYACKQMKQRFESIEQVNNLREIQALRRLNPHPNILMLHEVVFDRKSGSLALICELMDMNIYELIRGRRYPLSEKKIMHYMYQLCKSLDHIHRYALGDLTALKLIKCVNIQIQEFEYNEDVILFFLYTECRNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRKTEKRALGSHRKAGFPEHPVAPEPLSNSCQISKEGRKQKQSLKQEEDRPKRRGPAYVMELPKLKLSGVVRLSSYSSPTLQSVLGSGTNGRVPVLRPLKCIPASKKTDPQKDLKPAPQQCRLPTIVRKGGR

SEQ ID NO: 850885 - protein, 155 aa, Homo sapiens [sequence omitted]

SEQ ID NO: 850886 - protein, 262 aa, Homo sapiens; identical to SEQ ID NO: 850869

SEQ ID NO: 850887 - protein, 262 aa, Homo sapiens; identical to SEQ ID NO: 850869

SEQ ID NO: 850888 - protein, 262 aa, Homo sapiens; identical to SEQ ID NO: 850869

SEQ ID NO: 850889 - protein, 75 aa, Homo sapiens
HAQATAHGVQGLTVARVTGTQHGGGISNALLRGTTTEILVRDPASGKWKAGGQPSCFFLFRPVSARGCHRLPHPR

SEQ ID NO: 850890 - protein, 187 aa, Homo sapiens
MNFDFPFKKGSGIPLLTTNLSPQCLSLLHAMVAYDPDERIAAHQALQHPYFQEQRTQNGSEDEGLSRPPPHSNTFIPQPSAEHLHAARPQCHPSCVSLPSSTHLTLLTLKKTPGRSTGEPSHTPHWRGQALQGEAVSSHLHQPFPSGTQTCTSSCDRRQQCDRDLPSALLSPHLRCSQPATRQLESS

SEQ ID NO: 850891 - protein, 73 aa, Homo sapiens; identical to SEQ ID NO: 850865

SEQ ID NO: 850892 - protein, 256 aa, Homo sapiens
MKLTRKMVLTRAKASELHSVRKLNCWGSRLTDISICQEMPSLEVITLSVNSISTLEPVSRCQRLSELYLRRNRIPSLAELFYLKGLPRLRVLWLAENPCCGTSPHRYRMTVLRTLPRLQKLDNQAVTEEELSRALSEGEEITAAPEREGTGHGGPKLCCTLSSLSSAAETGRDPLDSEEEATSGAQDERGLKPPSRGQFPSLSARDASSSHRGRNVLTAILLLLRELDAEGLEAVQQTVGSRLQALRGEEVQEHAE

SEQ ID NO: 850893 - protein, 228 aa, Homo sapiens
SIRAGGGRDGRTGRLGCKVVSEGNLAYSWASKVMNALSPLLAASDSNDAVVKFNKDRVRARRSLTFLLQSAGRLGCKVVSEENLAYSWAFILGTLAEQGRSPQGGHICPGTPRVLASSAPQCHHCLPVSLHPMTCARLLGSLPSQQTKGSLNEQMLLDFQAVGVYLGALGKRRAPFIPEFPPAYCGTHGGSRRSWLTTAHQTLDGRLLWVSAFKSSQGFKPCGEGPPL

SEQ ID NO: 850894 - protein, 256 aa, Homo sapiens; identical to SEQ ID NO: 850892

SEQ ID NO: 850895 - protein, 256 aa, Homo sapiens; identical to SEQ ID NO: 850892

SEQ ID NO: 850896 - protein, 218 aa, Homo sapiens
MPSLEVITLSVNSISTLEPVSRCQRLSELYLRRNRIPSLAELFYLKGLPRLRVLWLAENPCCGTSPHRYRMTVLRTLPRLQKLDNQAVTEEELSRALSEGEEITAAPEREGTGHGGPKLCCTLSSLSSAAETGRDPLDSEEEATSGAQDERGLKPPSRGQFPSLSARDASSSHRGRNVLTAILLLLRELDAEGLEAVQQTVGSRLQALRGEEVQEHAE

SEQ ID NO: 850897 - protein, 143 aa, Homo sapiens
MKLTRKMVLTRAKASELHSVRKLNCWGSRLTDISICQEMPSLEVITLSVNSISTLEPVSRCQRLSELYLRRNRIPSLAELFYLKGLPRLRVLWLAENPCCGTSPHRYRMTVLRTLPRLQKLDNQDVSCEVSSRGCSPGFCVSS

SEQ ID NO: 850898 - protein, 121 aa, Homo sapiens
MKLTRKMVLTRAKASELHSVRKLNCCVNSISTLEPVSRCQRLSELYLRRNRIPSLAELFYLKGLPRLRVLWLAENPCCGTSPHRYRMTVLRTLPRLQKLDNQDVSCEVSSRGCSPGFCVSS

SEQ ID NO: 850899 - protein, 278 aa, Homo sapiens
LSSGPGLPTALSSAQVLLHVTCDIRFRLLRRGQGHRSHECLLLGVGIERWPWGPWPRPSLTVLVSVQVNSVNSISTLEPVSRCQRLSELYLRRNRIPSLAELFYLKGLPRLRVLWLAENPCCGTSPHRYRMTVLRTLPRLQKLDNQAVTEEELSRALSEGEEITAAPEREGTGHGGPKLCCTLSSLSSAAETGRDPLDSEEEATSGAQDERGLKPPSRGQFPSLSARDASSSHRGRNVLTAILLLLRELDAEGLEAVQQTVGSRLQALRGEEVQEHAE

SEQ ID NO: 850900 - protein, 256 aa, Homo sapiens; identical to SEQ ID NO: 850892

SEQ ID NO: 850901 - protein, 172 aa, Homo sapiens
GPCWAEGNRSHVEEVPHTRPQAGLLCSDSPSVPVSHLDGPHPRDQSLRGGAPLARPQPLWREAASLCRVGLVRTPLPSERPDCHPAAAAGAGCRGAGGRAADCGQPAAGPAWGRGAGARRVTAGPERRSSLHGDPSVFPSPRELEGGCHGRSPGPTQKPPRFATSAEGRSGC

SEQ ID NO: 850902 - protein, 114 aa, Homo sapiens
SRANVSAAPKRPQRARVAPLSSPSRQSAQDPPLTTRAPPLETRAAQSSPARDQEAGGARRSGLGGRHEADAEDGSDPGQGLGAAQRAQAQLLGQPPHRCKYCLTDVSIALIISK

SEQ ID NO: 850903 - protein, 256 aa, Homo sapiens; identical to SEQ ID NO: 850892

SEQ ID NO: 850904 - protein, 182 aa, Homo sapiens [sequence omitted]

SEQ ID NO: 850905 - protein, 143 aa, Homo sapiens; identical to SEQ ID NO: 850897

SEQ ID NO: 850906 - protein, 172 aa, Homo sapiens; identical to SEQ ID NO: 850901

SEQ ID NO: 850907 - protein, 157 aa, Homo sapiens
MKLTRKMVLTRAKASELHSVRKLNCWGSRLTDISICQEMPSLEVITLRYLAPAVMLSLGPGSRGRASRPSSGTQHCDITWKPPTQTEGGFQKGRGRDSESWAYPVAPMFSPPSSEPHLGLLMAPVPCLPCCTPAHPWPVCSDKPLLCSLGQSVVEPS

SEQ ID NO: 850908 - protein, 224 aa, Homo sapiens
MREGACKLLAACSQREQALEATKSLLVCNSRILSYMGELQRRKEAQVLGKTSRRPSDSGPPAERSPCRGRVCISDLRIPLMWKDTEYFKNKGDLHRWAVFLLLQLGEHIQDTEMILVDRTLTDISFQSNVLFAEAGPDFELRLELYGACVEEEGALTGGPKRLATKLSSSLGRSSGRRVRASLDSAGGSGSSPILLPTPVVGGPVNTSWVQQINLGSVADGSGN

SEQ ID NO: 850909 - protein, 513 aa, Homo sapiens
MREGACKLLAACSQREQALEATKSLLVCNSRILSYMGELQRRKEAQVLGKTSRRPSDSGPPAERSPCRGRVCISDLRIPLMWKDTEYFKNKGDLHRWAVFLLLQLGEHIQDTEMILVDRTLTDISFQSNVLFAEAGPDFELRLELYGACVEEEGALTGGPKRLATKLSSSLGRSSGRRVRASLDSAGGSGSSPILLPTPVVGGPRYHLLAHTTLTLAAVQDGFRTHDLTLASHEENPAWLPLYGSVCCRLAAQPLCMTQPTASGTLRVQQAGEMQNWAQVHGVLKGTNLFCYRQPEDADTGEEPLLTIAVNKETRVRAGELDQALGRPFTLSISNQYGDDEVTHTLQTESREALQSWMEALWQLFFDMSQWKQCCDEIMKIETPAPRKPPQALAKQGSLYHEMAIEPLDDIAAVTDILTQREGARLETPPPWLAMFTDQPALPNPCSPASVAPAPDWTHPLPWGRPRTFSLDAVPPDHSPRARSVAPLPPQRSPRTRGLCSKGQPRTWLQSPV

SEQ ID NO: 850910 - protein, 458 aa, Homo sapiens
MQDRLHILEDLNMLYIRQMALSLEDTELQRKLDHEIRMREGACKLLAACSQREQALEATKSLLVCNSRILSYMGELQRRKEAQVLGKTSRRPSDSGPPAERSPCRGRVCISDLRIPLMWKDTEYFKNKGDLHRWAVFLLLQLGEHIQDTEMILVDRTLTDISFQSNVLFAEAGPDFELRLELYGACVEEEGALTGGPKRLATKLSSSLGRSSGRRVRASLDSAGGSGSSPILLPTPVVGGPRYHLLAHTTLTLAAVQDGFRTHDLTLASHEENPAWLPLYGSVCCRLAAQPLCMTQPTASGTLRVQVRGPGGVEGSREKAEESWITRNRRANEKSRFGWKKWGMARRGEEWTAGWTKRTGSHGGLRRGILGAVTSPENVESFVQQAGEMQNWAQVHGVLKGTNLFCYRQPEDADTGEEPLLTIAVNKVMGPLVVRPPRAQAQEPLLQAPGGWAHTSER

SEQ ID NO: 850911 - protein, 550 aa, Homo sapiens
MQDRLHILEDLNMLYIRQMALSLEDTELQRKLDHEIRMREGACKLLAACSQREQALEATKSLLVCNSRILSYMGELQRRKEAQVLGKTSRRPSDSGPPAERSPCRGRVCISDLRIPLMWKDTEYFKNKGDLHRWAVFLLLQLGEHIQDTEMILVDRTLTDISFQSNVLFAEAGPDFELRLELYGACVEEEGALTGGPKRLATKLSSSLGRSSGRRVRASLDSAGGSGSSPILLPTPVVGGPRYHLLAHTTLTLAAVQDGFRTHDLTLASHEENPAWLPLYGSVCCRLAAQPLCMTQPTASGTLRVQQAGEMQNWAQVHGVLKGTNLFCYRQPEDADTGEEPLLTIAVNKETRVRAGELDQALGRPFTLSISNQYGDDEVTHTLQTESREALQSWMEALWQLFFDMSQWKQCCDEIMKIETPAPRKPPQALAKQGSLYHEMAIEPLDDIAAVTDILTQREGARLETPPPWLAMFTDQPALPNPCSPASVAPAPDWTHPLPWGRPRTFSLDAVPPDHSPRARSVAPLPPQRSPRTRGLCSKGQPRTWLQSPV

SEQ ID NO: 850912 - protein, 606 aa, Homo sapiens
MQDRLHILEDLNMLYIRQMALSLEDTELQRKLDHEIRMREGACKLLAACSQREQALEATKSLLVCNSRILSYMGELQRRKEAQVLGKTSRRPSDSGPPAERSPCRGRVCISDLRIPLMWKDTEYFKNKGDLHRWAVFLLLQLGEHIQDTEMILVDRTLTDISFQSNVLFAEAGPDFELRLELYGACVEEEGALTGGPKRLATKLSSSLGRSSGRRVRASLDSAGGSGSSPILLPTPVVGGPRYHLLAHTTLTLAAVQDGFRTHDLTLASHEENPAWLPLYGSVCCRLAAQPLCMTQPTASGTLRVQQAGEMQNWAQVHGVLKGTNLFCYRQPEDADTGEEPLLTIAVNKETRVRAGELDQALGRPFTLSISNQYGDDEVTHTLQTESREALQSWMEALWQLFFDMSQWKQCCDEIMKIETPAPRKPPQALAKQGSLYHEMAIEPLDDIAAVTDILTQREGARLETPPPWLAMFTDQPALPNPCSPARLPPSHLSDPHGPEASAAKANLALGSSHQCERERCWHRICPEEKMTHAQLGSGYGAVYSKLASLASCSSAGPGVGCRGGQKPLLNCGCHGTEGLIPGARWDLPKPFLEENWNQLCPTSLH

SEQ ID NO: 850913 - protein, 433 aa, Homo sapiens
MWKDTEYFKNKGDLHRWAVFLLLQLGEHIQDTEMILVDRTLTDISFQSNVLFAEAGPDFELRLELYGACVEEEGALTGGPKRLATKLSSSLGRSSGRRVRASLDSAGGSGSSPILLPTPVVGGPRYHLLAHTTLTLAAVQDGFRTHDLTLASHEENPAWLPLYGSVCCRLAAQPLCMTQPTASGTLRVQQAGEMQNWAQVHGVLKGTNLFCYRQPEDADTGEEPLLTIAVNKETRVRAGELDQALGRPFTLSISNQYGDDEVTHTLQTESREALQSWMEALWQLFFDMSQWKQCCDEIMKIETPAPRKPPQALAKQGSLYHEMAIEPLDDIAAVTDILTQREGARLETPPPWLAMFTDQPALPNPCSPASVAPAPDWTHPLPWGRPRTFSLDAVPPDHSPRARSVAPLPPQRSPRTRGLCSKGQPRTWLQSPV

SEQ ID NO: 850914 - protein, 380 aa, Homo sapiens
MQDRLHILEDLNMLYIRQMALSLEDTELQRKLDHEIRMREGACKLLAACSQREQALEATKSLLVCNSRILSYMGELQRRKEAQVLGKTSRRPSDSGPPAERSPCRGRVCISDLRIPLMWKDTEYFKNKGDLHRWAVFLLLQLGEHIQDTEMILVDRTLTDISFQSNVLFAEAGPDFELRLELYGACVEEEGALTGGPKRLATKLSSSLGRSSGRRVRASLDSAGGSGSSPILLPTPVVGGPRYHLLAHTTLTLAAVQDGFRTHDLTLASHEENPAWLPLYGSVCCRLAAQPLCMTQPTASGTLRVQQAGEMQNWAQVHGVLKGTNLFCYRQPEDADTGEEPLLTIAVNKVMGPLVVRPPRAQAQEPLLQAPGGWAHTSER

SEQ ID NO: 850915 - protein, 547 aa, Homo sapiens
MQDRLHILEDLNMLYIRQMALSLEDTELQRKLDHEIRMREGACKLLAACSQREQALEATKSLLVCNSRILSYMGELQRRKEAQVLGKTSRRPSDSGPPAERSPCRGRVCISDLRIPLMWKDTEYFKNKGDLHRWAVFLLLQLGEHIQDTEMILVDRTLTDISFQSNVLFAEAGPDFELRLELYGACVEEEGALTGGPKRLATKLSSSLGRSSGRRVRASLDSAGGSGSSPILLPTPVVGGPRYHLLAHTTLTLAAVQDGFRTHDLTLASHEENPAWLPLYGSVCCRLAAQPLCMTQPTASGTLRVQQAGEMQNWAQVHGVLKGTNLFCYRQPEDADTGEEPLLTIAVNKETRVRAGELDQALGRPFTLSISNQYGDDEVTHTLQTESREALQSWMEALWQLFFDMSQWKQCCDEIMKIETPAPRKPPQALAKQGSLYHEMAIEPLDDIAAVTDILTQREGARLETPPPWLAMFTDQPALPNPCSPASVAPAPDWTHPLPWGRPRTFSLDAVPPDHSPRARSVAPLPPQRSPRTRGLCSKGTLVSAGR

SEQ ID NO: 850916 - protein, 380 aa, Homo sapiens; identical to SEQ ID NO: 850914

SEQ ID NO: 850917 - protein, 489 aa, Homo sapiens
MQDRLHILEDLNMLYIRQMALSLEDTELQRKLDHEIRMREGACKLLAACSQREQALEATKSLLVCNSRILSYMGELQRRKEAQVLGKTSRRPSDSGPPAERSPCRGRVCISDLRIPLMWKDTEYFKNKGDLHRWAVFLLLQLGEHIQDTEMILVDRTLTDISFQSNVLFAEAGPDFELRLELYGACVEEEGALTGGPKRLATKLSSSLGRSSGRRVRASLDSAGGSGSSPILLPTPVVGGPRYHLLAHTTLTLAAVQDGFRTHDLTLASHEENPAWLPLYGSVCCRLAAQPLCMTQPTASGTLRVQQAGEMQNWAQVHGVLKGTNLFCYRQPEDADTGEEPLLTIAVNKETRVRAGELDQALGRPFTLSISNQYGDDEVTHTLQTESREALQSWMEALWQLFFDMSQWKQCCDEIMKIETPAPRKPPQALAKQGSLYHEMAIEPLDDIAAVTDILTQREGARLETPPPWLAMFTDQPALPNPCSPASPS

SEQ ID NO: 850918 - protein, 239 aa, Homo sapiens
MQDRLHILEDLNMLYIRQMALSLEDTELQRKLDHEIRMREGACKLLAACSQREQALEATKSLLVCNSRILSYMGELQRRKEAQVLGKTSRRPSDSGPPAERSPCRGRVCISDLRIPLMWKDTEYFKNKGDLHRWAVFLLLQLGEHIQDTEMILVDRTLTDISFQSNVLFAEAGPDFELRLELYGACVEEEGALTGGPKRLATKLSSSLGRSSGRRVRASLDSAGGSGSSPILLPTPVVG

SEQ ID NO: 850919 - protein, 153 aa, Homo sapiens
EEVPNGEDHSKTVDTPGSQEFGMSPQTTPLGLARLPPSHLSDPHGPEASAAKANLALGSSHQCERERCWHRICPEEKMTHAQLGSGYGAVYSKLASLASCSSAGPGVGCRGGQKPLLNCGCHGTEGLIPGARWDLPKPFLEENWNQLCPTSLH

SEQ ID NO: 850920 - protein, 105 aa, Homo sapiens [sequence omitted]

SEQ ID NO: 850921 - protein, 563 aa, Homo sapiens
MFSRNHRSRVTVARGSALEMEFKRGRFRLSLFSDLPEDTELQRKLDHEIRMREGACKLLAACSQREQALEATKSLLVCNSRILSYMGELQRRKEAQVLGKTSRRPSDSGPPAERSPCRGRVCISDLRIPLMWKDTEYFKNKGDLHRWAVFLLLQLGEHIQDTEMILVDRTLTDISFQSNVLFAEAGPDFELRLELYGACVEEEGALTGGPKRLATKLSSSLGRSSGRRVRASLDSAGGSGSSPILLPTPVVGGPRYHLLAHTTLTLAAVQDGFRTHDLTLASHEENPAWLPLYGSVCCRLAAQPLCMTQPTASGTLRVQQAGEMQNWAQVHGVLKGTNLFCYRQPEDADTGEEPLLTIAVNKETRVRAGELDQALGRPFTLSISNQYGDDEVTHTLQTESREALQSWMEALWQLFFDMSQWKQCCDEIMKIETPAPRKPPQALAKQGSLYHEMAIEPLDDIAAVTDILTQREGARLETPPPWLAMFTDQPALPNPCSPASVAPAPDWTHPLPWGRPRTFSLDAVPPDHSPRARSVAPLPPQRSPRTRGLCSKGQPRTWLQSPV

SEQ ID NO: 850922 - protein, 550 aa, Homo sapiens; identical to SEQ ID NO: 850911

SEQ ID NO: 850923 - protein, 380 aa, Homo sapiens; identical to SEQ ID NO: 850914

SEQ ID NO: 850924 - protein, 523 aa, Homo sapiens
MQDRLHILEDLNMLYIRQMALSLEDTELQRKLDHEIRMREGACKLLAACSQREQALEATKSLLVCNSRILSYMGELQRRKEAQVLGKTSRRPSDSGPPAERSPCRGRVCISDLRIPLMWKDTEYFKNKGDLHRWAVFLLLQLGEHIQDTEMILVDRTLTDISFQSNVLFAEAGPDFELRLELYGACVEEEGALTGGPKRLATKLSSSLGRSSGRRVRASLDSAGGSGSSPILLPTPVVGGPRYHLLAHTTLTLAAVQDGFRTHDLTLASHEENPAWLPLYGSVCCRLAAQPLCMTQPTASGTLRVQDADTGEEPLLTIAVNKETRVRAGELDQALGRPFTLSISNQYGDDEVTHTLQTESREALQSWMEALWQLFFDMSQWKQCCDEIMKIETPAPRKPPQALAKQGSLYHEMAIEPLDDIAAVTDILTQREGARLETPPPWLAMFTDQPALPNPCSPASVAPAPDWTHPLPWGRPRTFSLDAVPPDHSPRARSVAPLPPQRSPRTRGLCSKGQPRTWLQSPV

SEQ ID NO: 850925 - protein, 550 aa, Homo sapiens; identical to SEQ ID NO: 850911

SEQ ID NO: 850926 - protein, 115 aa, Homo sapiens [sequence omitted]

SEQ ID NO: 850927 - protein, 380 aa, Homo sapiens; identical to SEQ ID NO: 850914

SEQ ID NO: 850928 - protein, 132 aa, Homo sapiens [sequence omitted]

SEQ ID NO: 850929 - protein, 759 aa, Homo sapiens
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKVNNNLSDELRIMQKKLQTLQSENSNLRKQATTNVYQVQTGSEYTDTSNHSSLKRRPSARGSRPMSMYETGSGQKPYLPMGEASRPEESRMRLQPFPAHIGRSALVTSSSSLPSFPSTLSWSRDESARRASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 850930 - protein, 759 aa, Homo sapiens; identical to SEQ ID NO: 850929

SEQ ID NO: 850931 - protein, 697 aa, Homo sapiens
MVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKVNNNLSDELRIMQKKLQTLQSENSNLRKQATTNVYQVQTGSEYTDTSNHSSLKRRPSARGSRPMSMYETGSGQKPYLPMGEASRPEESRMRLQPFPAHIGRSALVTSSSSLPSFPSTLSWSRDESARRASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 850932 - protein, 508 aa, Homo sapiens [sequence omitted]

SEQ ID NO: 850933 - protein, 477 aa, Homo sapiens
MDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKVNNNLSDELRIMQKKLQTLQSENSNLRKQATTNVYQVQTGSEYTDTSNHSSLKRRPSARGSRPMSMYETGSGQKPYLPMGEASRPEESRMRLQPFPAHIGRSALVTSSSSLPSFPSTLSWSRDESARRASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 850934 - protein, 161 aa, Homo sapiens
MEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 850935 - protein, 161 aa, Homo sapiens; identical to SEQ ID NO: 850934

SEQ ID NO: 850936 - protein, 245 aa, Homo sapiens [sequence omitted]

SEQ ID NO: 850937 - protein, 759 aa, Homo sapiens; identical to SEQ ID NO: 850929

SEQ ID NO: 850938 - protein, 649 aa, Homo sapiens
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKVNNNLSDELRIMQKKLQTLQSENSNLRKQATTNVYQVQTGSEYTDTSNHSSLKRRPSARGSRPMSMYETGSGQKPYLPMGEASRPEESRMRLQPFPAHIGRSALVTSSSSLPSFPSTLSWSRDESARRASRLEKQNSTPESDYDNTPNDMEPDGMGYMHRTSVPGEGLPRARDLAGLGQQKQFTTHTPFLYFQTHKVLKY

SEQ ID NO: 850939 - protein, 406 aa, Homo sapiens
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGIQNLGRLPPRQAFPTRVFYIFMYAQRGGHAGQVLLLGVHIDIVELILPTVHYHHRVLTLDTDQPDYRQPGMKALDS

SEQ ID NO: 850940 - protein, 471 aa, Homo sapiens
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKVNNNLSDELRIMQKKLLGKDAN

SEQ ID NO: 850941 - protein, 759 aa, Homo sapiens; identical to SEQ ID NO: 850929

SEQ ID NO: 850942 - protein, 683 aa, Homo sapiens
AAAPNIRMVIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKVNNNLSDELRIMQKKLQTLQSENSNLRKQATTNVYQVQTGSEYTDTSNHSSLKRRPSARGSRPMSMYETGSGQKPYLPMGEASRPEESRMRLQPFPAHIGRSALVTSSSSLPSFPSTLSWSRDESARRASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 850943 - protein, 508 aa, Homo sapiens [sequence omitted]

SEQ ID NO: 850944 - protein, 277 aa, Homo sapiens
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSYSFIV

SEQ ID NO: 850945 - protein, 631 aa, Homo sapiens
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKSLDSDLSDGPVTVQEFMEVKNALVASEAKIQQLMKASRLEKQNSTPESDYDNTPNDMEPDGMGSSRKGRQRSMVWPGDGLVPDTAEPHVAPSPTLPSTEDVIRKTEQITKNIQELLRAAQENKHDSYIPCSERIHVAVTEMAALFPKKPKSDMVRTSLRLLTSSAYRLQSECKKTLPGDPGSPTDVQLVTQQVIQCAYDIAKAAKQLVTITTKENNN

SEQ ID NO: 850946 - protein, 439 aa, Homo sapiens
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSLSNHLFEELAMDVYDEVDRRETDAVWLATQNHSALVTETTVVPFLPVNPEYSSTRNQGRQKLARFNAHEFATLVIDILSDAKRRQQGSSLSGSKDNVELILKTINNQHSVESQDNDQPDYDSVASDEDTDLETTASKTNRQKVRGHASHGRASTHQLRASPAKAAVQ

SEQ ID NO: 850947 - protein, 283 aa, Homo sapiens
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADSSLDLSELAKAAKKKLQSVSIFLYWFSLV

SEQ ID NO: 850948 - protein, 395 aa, Homo sapiens [sequence omitted]

SEQ ID NO: 850949 - protein, 395 aa, Homo sapiens [sequence omitted]

SEQ ID NO: 850950 - protein, 395 aa, Homo sapiens [sequence omitted]

SEQ ID NO: 850951 - protein, 395 aa, Homo sapiens
MDLGIPDLLDAWLEPPEDIFSTGSVLELGLHCPPPEVPVTRLQEQGLQGWKSGGDRGCGLQESEPEDFLKLFIDPNEVYCSEASPGSDSGISEDPCHPDSPPAPRATSSPMLYEVVYEAGALERMQGETGPNVGLISIQLDQWSPAFMVPDSCMVSELPFDAHAHILPRAGTVAPVPCTTLLPCQTLFLTDEEKRLLGQEGVSLPSHLPLTKAEERVLKKVRRKIRNKQSAQDSRRRKKEYIDGLESRVAACSAQNQELQKKVQELERHNISLVAQLRQLQTLIAQTSNKAAQTSTCVLILLFSLALIILPSFSPFQSRPEAGSEDYQPHGVTSRNILTHKDVTENLETQVVESRLREPPGAKDANGSTRTLLEKMGGKPRPSGRIRSVLHADEM

SEQ ID NO: 850952 - protein, 214 aa, Homo sapiens
MDLGIPDLLDAWLEPPEDIFSTGSVLELGLHCPPPEVPVTRLQEQGLQGWKSGGDRGCGLQESEPEDFLKLFIDPNEVYCSEASPGSDSGISEDSCHPDSPPAPRATSSPMLYEVVYEAGALERMQGETGPNVGLISIQLDQWSPAFMVPDSCMVSELPFDAHAHILPRAGTVAPVPCTTLGLTLSSRLECSGAITAHCILNILGSSNPPASAS

SEQ ID NO: 850953 - protein, 414 aa, Homo sapiens
MDLGIPDLLDAWLEPPEDIFSTGSVLELGLHCPPPEVPGLQESEPEDFLKLFIDPNEVYCSEASPGSDSGISEDSCHPDSPPAPRATSSPMLYEVVYEAGALERMQGETGPNVGLISIQLDQWSPAFMVPDSCMVSELPFDAHAHILPRAGTVAPVPCTTLGLTLSSRLECSGAITAHCILNILGSSNLLPQPPEELGLQLPCQTLFLTDEEKRLLGQEGVSLPSHLPLTKAEERVLKKVRRKIRNKQSAQDSRRRKKEYIDGLESRVAACSAQNQELQKKVQELERHNISLVAQLRQLQTLIAQTSNKAAQTSTCVLILLFSLALIILPSFSPFQSRPEAGSEDYQPHGVTSRNILTHKDVTENLETQVVESRLREPPGAKDANGSTRTLLEKMGGKPRPSGRIRSVLHADEM

SEQ ID NO: 850954 - protein, 395 aa, Homo sapiens [sequence omitted]

SEQ ID NO: 850955 - protein, 375 aa, Homo sapiens [sequence omitted]

SEQ ID NO: 850956 - protein, 375 aa, Homo sapiens [sequence omitted]

SEQ ID NO: 850957 - protein, 427 aa, Homo sapiens
MDLGIPDLLDAWLEPPEDIFSTGSVLELGLHCPPPEVPGLQESEPEDFLKLFIDPNEVYCSEASPGSDSGISEDSCHPDSPPAPRATSSPMLYEVVYEAGALERMQGETGPNVGLISIQLGQCSLWEGGNGPSGLALTMGLRGFTQPVPLPRPCGCQGVPKSPFSQLLFSTPDQWSPAFMVPDSCMVSELPFDAHAHILPRAGTVAPVPCTTLLPCQTLFLTDEEKRLLGQEGVSLPSHLPLTKAEERVLKKVRRKIRNKQSAQDSRRRKKEYIDGLESRVAACSAQNQELQKKVQELERHNISLVAQLRQLQTLIAQTSNKAAQTSTCVLILLFSLALIILPSFSPFQSRPEAGSEDYQPHGVTSRNILTHKDVTENLETQVVESRLREPPGAKDANGSTRTLLEKMGGKPRPSGRIRSVLHADEM

SEQ ID NO: 850958 - protein, 189 aa, Homo sapiens
MDLGIPDLLDAWLEPPEDIFSTGSVLELGLHCPPPEVPVTRLQEQGLQGWKSGGDRGCGLQESEPEDFLKLFIDPNEVYCSEASPGSDSGISEDSCHPDSPPAPRATSSPMLYEVVYEAGALERMQGETGPNVGLISIQLDQWSPAFMVPDSCMVSELPFDAHAHILPRAGTVAPVPCTTLLVCICLHI

SEQ ID NO: 850959 - protein, 1199 aa, Homo sapiens
MPLTGVEPARMNRKKGDKGFESPRPYKLTHQVVCINNINFQRKSVVGFVELTIFPTVANLNRIKLNSKQCRIYRVRINDLEAAFIYNDPTLEVCHSESKQRNLNYFSNAYAAAVSAVDPDAGNGELCIKVPSELWKHVDELKVLKIHINFSLDQPKGGLHFVVPSVEGSMAERGAHVFSCGYQNSTRFWFPCVDSYSELCTWKLEFTVDAAMVAVSNGDLVETVYTHDMRKKTFHYMLTIPTAASNISLAIGPFEILVDPYMHEVTHFCLPQLLPLLKHTTSYLHEVFEFYEEILTCRYPYSCFKTVFIDEAYVEVAAYASMSIFSTNLLHSAMIIDETPLTRRCLAQSLAQQFFGCFISRMSWSDEWVLKGISGYIYGLWMKKTFGVNEYRHWIKEELDKIVAYELKTGGVLLHPIFGGGKEKDNPASHLHFSIKHPHTLSWEYYTMFQCKAHLVMRLIENRISMEFMLQVFNKLLSLASTASSQKFQSHMWSQMLVSTSGFLKSISNVSGKDIQPLIKQWVDQSGVVKFYGSFAFNRKRNVLELEIKQDYTSPGTQKYVGPLKVTVQELDGSFNHTLQIEENSLKHDIPCHSKSRRNKKKKIPLMNGEEVDMDLSAMDADSPLLWIRIDPDMSVLRKVEFEQADFMWQYQLRYERDVVAQQESILALEKFPTPASRLALTDILEQEQCFYRVRMSACFCLAKIANSMVSTWTGPPAMKSLFTRMFCCKSCPNIVKTNNFMSFQSYFLQKTMPVAMALLRDVHNLCPKEVLTFILDLIKYNDNRKNKFSDNYYRAEMIDALANSVTPAVSVNNEVRTLDNLNPDVRLILEEITRFLNMEKLLPSYRHTITVSCLRAIRVLQKNGHVPSDPALFKSYAEYGHFVDIRIAALEAVVDYTKVDRSYEELQWLLNMIQNDPVPYVRHKILNMLTKNPPFTKNMESPLCNEALVDQLWKLMNSGTSHDWRLRCGAVDLYFTLFGLSRPSCLPLPELGLVLNLKEKKAVLNPTIIPESVAGNQEAANNPSSHPQLVGFQNPFSSSQDEEEIDMDTVHDSQAFISHHLNMLERPSTPGLSKYRPASSRSALIPQHSAGCDSTPTTKPQWSLELARKGTGKEQAPLEMSMHPAASAPLSVFTKESTASKHSDHHHHHHHEHKKKKKKHKHKHKHKHKHDSKEKDKEPFTFSSPASGRSIRSPSLSD

SEQ ID NO: 850960 - protein, 752 aa, Homo sapiens
MFQCKAHLVMRLIENRISMEFMLQVFNKLLSLASTASSQKFQSHMWSQMLVSTSGFLKSISNVSGKDIQPLIKQWVDQSGVVKFYGSFAFNRKRNVLELEIKQDYTSPGTQKYVGPLKVTVQELDGSFNHTLQIEENSLKHDIPCHSKSRRNKKKKIPLMNGEEVDMDLSAMDADSPLLWIRIDPDMSVLRKVEFEQADFMWQYQLRYERDVVAQQESILALEKFPTPASRLALTDILEQEQCFYRVRMSACFCLAKIANSMVSTWTGPPAMKSLFTRMFCCKSCPNIVKTNNFMSFQSYFLQKTMPVAMALLRDVHNLCPKEVLTFILDLIKYNDNRKNKFSDNYYRAEMIDALANSVTPAVSVNNEVRTLDNLNPDVRLILEEITRFLNMEKLLPSYRHTITVSCLRAIRVLQKNGHVPSDPALFKSYAEYGHFVDIRIAALEAVVDYTKVDRSYEELQWLLNMIQNDPVPYVRHKILNMLTKNPPFTKNMESPLCNEALVDQLWKLMNSGTSHDWRLRCGAVDLYFTLFGLSRPSCLPLPELGLVLNLKEKKAVLNPTIIPESVAGNQEAANNPSSHPQLVGFQNPFSSSQDEEEIDMDTVHDSQAFISHHLNMLERPSTPGLSKYRPASSRSALIPQHSAGCDSTPTTKPQWSLELARKGTGKEQAPLEMSMHPAASAPLSVFTKESTASKHSDHHHHHHHEHKKKKKKHKHKHKHKHKHDSKEKDKEPFTFSSPASGRSIRSPSLSD

SEQ ID NO: 850961 - protein, 152 aa, Homo sapiens [sequence omitted]

SEQ ID NO: 850962 - protein, 383 aa, Homo sapiens
MPLTGVEPARMNRKKGDKGFESPRPYKLTHQVVCINNINFQRKSVVGFVELTIFPTVANLNRIKLNSKQCRIYRVRINDLEAAFIYNDPTLEVCHSESKQRNLNYFSNAYAAAVSAVDPDAGNGELCIKVPSELWKHVDELKVLKIHINFSLDQPKGGLHFVVPSVEGSMAERGAHVFSCGYQNSTRFWFPCVDSYSELCTWKLEFTVDAAMVAVSNGDLVETVYTHDMRKKTFHYMLTIPTAASNISLAIGPFEILVDPYMHEVTHFCLPQLLPLLKHTTSYLHEVFEFYEEILTCRYPYSCFKTVFIDEAYVEVAAYASMSIFSTNLLHSAMIIDETPLTRRCLAQSLAQQFFGCFISRMSWSDEWALLEMLTGILYQRHP

SEQ ID NO: 850963 - protein, 154 aa, Homo sapiens
MPCCDSSRSGRIPAASNISLAIGPFEILVDPYMHEVTHFCLPQLLPLLKHTTSYLHEVFEFYEEILTCRYPYSCFKTVFIDEAYVEVAAYASMSIFSTNLLHSAMIIDETPLTRRCLAQSLAQQFFGCFISRMSWSDEWALLEMLTGILYQRHP

SEQ ID NO: 850964 - protein, 1251 aa, Homo sapiens
MPLTGVEPARMNRKKGDKGFESPRPYKLTHQVVCINNINFQRKSVVGFVELTIFPTVANLNRIKLNSKQCRIYRVRINDLEAAFIYNDPTLEVCHSESKQRNLNYFSNAYAAAVSAVDPDAGNGELCIKVPSELWKHVDELKVLKIHINFSLDQPKGGLHFVVPSVEGSMAERGAHVFSCGYQNSTRFWFPCVDSYSELCTWKLEFTVDAAMVAVSNGDLVETVYTHDMRKKTFHYMLTIPTAASNISLAIGPFEILVDPYMHEVTHFCLPQLLPLLKHTTSYLHEVFEFYEEILTCRYPYSCFKTVFIDEAYVEVAAYASMSIFSTNLLHSAMIIDETPLTRRCLAQSLAQQFFGCFISRMSWSDEWVLKGISGYIYGLWMKKTFGVNEYRHWIKEELDKIVAYELKTGGVLLHPIFGGGKEKDNPASHLHFSIKHPHTLSWEYYTMFQCKAHLVMRLIENRISMEFMLQVFNKLLSLASTASSQKFQSHMWSQMLVSTSGFLKSISNVSGKDIQPLIKQWVDQSGVVKFYGSFAFNRKRNVLELEIKQDYTSPGTQKYVGPLKVTVQELDGSFNHTLQIEENSLKHDIPCHSKSRRNKKKKIPLMNGEEVDMDLSAMDADSPLLWIRIDPDMSVLRKVEFEQADFMWQYQLRYERDVVAQQESILALEKFPTPASRLALTDILEQEQCFYRVRMSACFCLAKIANSMVSTWTGPPAMKSLFTRMFCCKSCPNIVKTNNFMSFQSYFLQKTMPVAMALLRDVHNLCPKEVLTFILDLIKYNDNRKNKFSDNYYRAEMIDALANSVTPAVSVNNEVRTLDNLNPDVRLILEEITRFLNMEKLLPSYRHTITVSCLRAIRVLQKNGHVPSDPALFKSYAEYGHFVDIRIAALEAVVDYTKVDRSYEELQWLLNMIQNDPVPYVRHKILNMLTKNPPFTKNMESPLCNEALVDQLWKLMNSGTSHDWRLRCGAVDLYFTLFGLSRPSCLPLPELGLVLNLKEKKAVLNPTIIPESVAGNQEAANNPSSHPQLVGFQNPEDDHLAKEASCNISAHQQGVKRKSDTPLGSPLEPGQILEKNEDSSKVKLKIRFSSSQDEEEIDMDTVHDSQAFISHHLNMLERPSTPGLSKYRPASSRSALIPQHSAGCDSTPTTKPQWSLELARKGTGKEQAPLEMSMHPAASAPLSVFTKESTASKHSDHHHHHHHEHKKKKKKHKHKHKHKHKHDSKEKDKEPFTFSSPASGRSIRSPSLSD

SEQ ID NO: 850965 - protein, 246 aa, Homo sapiens
AAPRRTERKCSLQLPGAGAQRLRPPVPRRPPSRGREGDRGSAVRGAASYRMSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWHAATKGILVAMVCTFFDAFNVPVFWPILVMYFIMLFCITMKRQIKHMIKYRYIPFTHGKRRYRGKEDAGKAFAS

SEQ ID NO: 850966 - protein, 246 aa, Homo sapiens; identical to SEQ ID NO: 850965

SEQ ID NO: 850967 - protein, 246 aa, Homo sapiens; identical to SEQ ID NO: 850965

SEQ ID NO: 850968 - protein, 246 aa, Homo sapiens; identical to SEQ ID NO: 850965

SEQ ID NO: 850969 - protein, 232 aa, Homo sapiens
MRSCEVAGPSPEPDKGPLKELHSSRRKLRSKPESYRMSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWHAATKGILVAMVCTFFDAFNVPVFWPILVMYFIMLFCITMKRQIKHMIKYRYIPFTHGKRRYRGKEDAGKAFAS

SEQ ID NO: 850970 - protein, 237 aa, Homo sapiens
AAPRRTERKCSLQLPGAGAQRLRPPVPRRPPSRGREGDRGSAVRGAASYRMSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWDASVCGDGRCSCKAGGGRQVPGAGCRCGANLLSPLEGMRLPRASLWLWSVLSSTLSTSRCSGRFW

SEQ ID NO: 850971 - protein, 196 aa, Homo sapiens
MSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWHAATKGILVAMVCTFFDAFNVPVFWPILVMYFIMLFCITMKRQIKHMIKYRYIPFTHGKRRYRGKEDAGKAFAS

SEQ ID NO: 850972 - protein, 285 aa, Homo sapiens
EVPVLEELGALPAPEVEREGGASAVSPARGGPGFPVQAPEPSPFSFSLRIDVLLLTREERGGGGGAEALVLLTVLNSAPLLGGGHGSYRMSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWHAATKGILVAMVCTFFDAFNVPVFWPILVMYFIMLFCITMKRQIKHMIKYRYIPFTHGKRRYRGKEDAGKAFAS

SEQ ID NO: 850973 - protein, 196 aa, Homo sapiens; identical to SEQ ID NO: 850971

SEQ ID NO: 850974 - protein, 196 aa, Homo sapiens; identical to SEQ ID NO: 850971

SEQ ID NO: 850975 - protein, 120 aa, Homo sapiens
MGRDTGPELCLHDSSLPAADDGPSLPTKQNEEFRPFIRRLPEFKFWHAATKGILVAMVCTFFDAFNVPVFWPILVMYFIMLFCITMKRQIKHMIKYRYIPFTHGKRRYRGKEDAGKAFAS

SEQ ID NO: 850976 - protein, 156 aa, Homo sapiens
AAPRRTERKCSLQLPGAGAQRLRPPVPRRPPSRGREGDRGSAVRGAASYRMSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSGILKTT

SEQ ID NO: 850977 - protein, 107 aa, Homo sapiens
RRRGGRSGSARCSFPEPERSACGRPCPAVLLPAAVRETAARPYAELRVTECLKGTVWENPSMGNLRWCTDFSQDLDRLVGFLVDEYKYLKKKRDSQHFREGSVCWCS

SEQ ID NO: 850978 - protein, 121 aa, Homo sapiens
MSEGDSVGESVHGKPSVVYRFFTRLGQIYQSWLDKSTPYTAVRWVVTLGLSFVYMIRVYLLQGWYIVTYALGIYHRTAVWVWIYQSWLDKSTPYTAVRWVVTLGLSFVYMIRVYQTLQQVN

SEQ ID NO: 850979 - protein, 246 aa, Homo sapiens; identical to SEQ ID NO: 850965

SEQ ID NO: 850980 - protein, 196 aa, Homo sapiens; identical to SEQ ID NO: 850971

SEQ ID NO: 850981 - protein, 246 aa, Homo sapiens; identical to SEQ ID NO: 850965

SEQ ID NO: 850982 - protein, 246 aa, Homo sapiens; identical to SEQ ID NO: 850965

SEQ ID NO: 850983 - protein, 308 aa, Homo sapiens
AAPRRTERKCSLQLPGAGAQRLRPPVPRRPPSRGREGDRGSAVRGAASYRMSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWHAATKGILVAMVCTFFDAFNVPVFWPILVMYFIMLFCITMKRQIKHMIKYRYIPFTHGKRSDVQVFLTDGILVSCRREARRVEPMGARASGRSPLCQVGRQEQGLRGRNGPLPASRLPQQPQVVPATPQSPRDDLA

SEQ ID NO: 850984 - protein, 231 aa, Homo sapiens
MDFQVAGPSPEPDKGPLKELHSSRRKLRSKPESYRMSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWHAATKGILVAMVCTFFDAFNVPVFWPILVMYFIMLFCITMKRQIKHMIKYRYIPFTHGKRRYRGKEDAGKAFAS

SEQ ID NO: 850985 - protein, 196 aa, Homo sapiens; identical to SEQ ID NO: 850971

SEQ ID NO: 850986 - protein, 196 aa, Homo sapiens; identical to SEQ ID NO: 850971

SEQ ID NO: 850987 - protein, 192 aa, Homo sapiens
NFERRYPGSEESSLQSLSQDVGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWHAATKGILVAMVCTFFDAFNVPVFWPILVMYFIMLFCITMKRQIKHMIKYRYIPFTHGKRRYRGKEDAGKAFAS

SEQ ID NO: 850988 - protein, 237 aa, Homo sapiens; identical to SEQ ID NO: 850970

SEQ ID NO: 850989 - protein, 106 aa, Homo sapiens
MSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSGILKTT

SEQ ID NO: 850990 - protein, 184 aa, Homo sapiens
KITARYEAGVTEPERSACGRPCPAVLLPAAVRETAARPYAELRGARKGCVARERPGSAASASSGLSRPRAGGAALRAGRGGPSGPGWPRGPCSRPAALRGTGRASGSGPGRGAGGCGGALGPARVGGAGEGPGGGCSPRATRAASRPHPLLGIWGKRAVAAPTALRVGLYSRVMCPVPILRPGQ

SEQ ID NO: 850991 - protein, 276 aa, Homo sapiens
MSFEGGDGAGPAMLATGTARMASGRPEELWEAVVGAAERFRARTGTELVLLTAAPPPPPRPGPCAYAAHGRGALAEAARRCLHDIALAHRAATAARPPAPPPAPQPPSPTPSPPRPTLAREDNEEDEDEPTETETSGEQLGISDNGGLFVMDEDATLQDLPPFCESDPESTDDGSLSEETPAGPPTCSVPPASALPTQQYAKSLPVSVPVWGFKEKRTEARSSDEENGPPSSPDLDRIAASMRALVLREAEDTQVFGDLPRPRLNTSDFQKLKRKY

SEQ ID NO: 850992 - protein, 256 aa, Homo sapiens
MASGRPEELWEAVVGAAERFRARTGTELVLLTAAPPPPPRPGPCAYAAHGRGALAEAARRCLHDIALAHRAATAARPPAPPPAPQPPSPTPSPPRPTLAREDNEEDEDEPTETETSGEQLGISDNGGLFVMDEDATLQDLPPFCESDPESTDDGSLSEETPAGPPTCSVPPASALPTQQYAKSLPVSVPVWGFKEKRTEARSSDEENGPPSSPDLDRIAASMRALVLREAEDTQVFGDLPRPRLNTSDFQKLKRKY

SEQ ID NO: 850993 - protein, 256 aa, Homo sapiens; identical to SEQ ID NO: 850992

SEQ ID NO: 850994 - protein, 369 aa, Homo sapiens
CTISRGSHAPALGEGQSGWSLPSWRRGFGWNLQPPLQEPSAGGRHCPRPSSGPTADRQTKLLQLPPASQTACIPLGAGPSPAPSQRTFSTTRMTPAMRESRSCYFLALVCRARMASGRPEELWEAVVGAAERFRARTGTELVLLTAAPPPPPRPGPCAYAAHGRGALAEAARRCLHDIALAHRAATAARPPAPPPAPQPPSPTPSPPRPTLAREDNEEDEDEPTETETSGEQLGISDNGGLFVMDEDATLQDLPPFCESDPESTDDGSLSEETPAGPPTCSVPPASALPTQQYAKSLPVSVPVWGFKEKRTEARSSDEENGPPSSPDLDRIAASMRALVLREAEDTQVFGDLPRPRLNTSDFQKLKRKY

SEQ ID NO: 850995 - protein, 222 aa, Homo sapiens
MASGAPRRTCAYAAHGRGALAEAARRCLHDIALAHRAATAARPPAPPPAPQPPSPTPSPPRPTLAREDNEEDEDEPTETETSGEQLGISDNGGLFVMDEDATLQDLPPFCESDPESTDDGSLSEETPAGPPTCSVPPASALPTQQYAKSLPVSVPVWGFKEKRTEARSSDEENGPPSSPDLDRIAASMRALVLREAEDTQVFGDLPRPRLNTSDFQKLKRKY

SEQ ID NO: 850996 - protein, 276 aa, Homo sapiens; identical to SEQ ID NO: 850991

SEQ ID NO: 850997 - protein, 263 aa, Homo sapiens [sequence omitted]

SEQ ID NO: 850998 - protein, 258 aa, Homo sapiens
MTQPQHLRLGESLGLSHLSAGRDSWKSRTDKRRGGRGWRRGAPRTCAYAAHGRGALAEAARRCLHDIALAHRAATAARPPAPPPAPQPPSPTPSPPRPTLAREDNEEDEDEPTETETSGEQLGISDNGGLFVMDEDATLQDLPPFCESDPESTDDGSLSEETPAGPPTCSVPPASALPTQQYAKSLPVSVPVWGFKEKRTEARSSDEENGPPSSPDLDRIAASMRALVLREAEDTQVFGDLPRPRLNTSDFQKLKRKY

SEQ ID NO: 850999 - protein, 256 aa, Homo sapiens; identical to SEQ ID NO: 850992

SEQ ID NO: 851000 - protein, 276 aa, Homo sapiens; identical to SEQ ID NO: 850991

SEQ ID NO: 851001 - protein, 276 aa, Homo sapiens; identical to SEQ ID NO: 850991

SEQ ID NO: 851002 - protein, 104 aa, Homo sapiens
MRTPPSRTFPPSVSQTPRVQMVSVPGCSPPDLGAGTRPTQRQGQKLKSTLSFRWQPERGDPRRPPHLLSAPSLSPTHTAVRQVPACVCARLGLQGEEDRGAVIR

SEQ ID NO: 851003 - protein, 374 aa, Homo sapiens
RNQAPKMAAAAEERMAEEGGGGQGDGGSSLASGSTQRQPPPPAPQHPQPGSQALPAPALAPDQLPQNNTLVALPIVAIENILSFMSYDEISQLRLVCKRMDLVCQRMLNQGFLKVERYHNLCQKQVKAQLPRRESERRNHSLARHADILAAVETRLSLLNMTFMKYVDSNLCCFIPGKVIDEIYRVLRYVNSTRAPQRAHEVLQELRDISSMAMEYFDEKIVPILKRKLPGSDVSGRLMGSPPVPGPSAALTTMQLFSKQNPSRQEVTKLQQQVKTNGAGVTVLRREISELRTKVQEQQKQLQDQDQKLLEQTQIIGEQNARLAELERKLREVMESAVGNSSGSGQNEESPRKRKKATEAIDSLRKSKRLRNRK

SEQ ID NO: 851004 - protein, 374 aa, Homo sapiens; identical to SEQ ID NO: 851003

SEQ ID NO: 851005 - protein, 374 aa, Homo sapiens; identical to SEQ ID NO: 851003

SEQ ID NO: 851006 - protein, 180 aa, Homo sapiens
RNQAPKMAAAAEERMAEEGGGGQGDGGSSLASGSTQRQPPPPAPQHPQPGSQALPAPALAPDQLPQNNTLVALPIVAIENILSFMSYDEISQLRLVCKRMDLVCQRMLNQGFLKVERYHNLCQKQVKAQLPRRESERRNHSLARHADILAAVETRLSLLNMTFMKYVDSNLCCFIPGKVK

SEQ ID NO: 851007 - protein, 374 aa, Homo sapiens; identical to SEQ ID NO: 851003

SEQ ID NO: 851008 - protein, 374 aa, Homo sapiens; identical to SEQ ID NO: 851003

SEQ ID NO: 851009 - protein, 68 aa, Homo sapiens
DVGAFAVWCVVVWGVLPFGPLGPGRSPSSPASLYLFSSPVFCWSPSVGFWMSLCGGRVVLFSPPLGGV

SEQ ID NO: 851010 - protein, 717 aa, Homo sapiens
MELRCGGLLFSSRFDSGNLAHVEKVESLSSDGEGVGGGASALTSGIASSPDYEFNVWTRPDCAETEFENGNRSWFYFSVRGGMPGKLIKINIMNMNKQSKLYSQGMAPFVRTLPTRPRWERIRDRPTFEMTETQFVLSFVHRFVEGRGATTFFAFCYPFSYSDCQELLNQLDQRFPENHPTHSSPLDTIYYHRELLCYSLDGLRVDLLTITSCHGLREDREPRLEQLFPDTSTPRPFRFAGKRIFFLSSRVHPGETPSSFVFNGFLDFILRPDDPRAQTLRRLFVFKLIPMLNPDGVVRGHYRTDSRGVNLNRQYLKPDAVLHPAIYGAKAVLLYHHVHSRLNSQSSSEHQPSSCLPPDAPVSDLEKANNLQNEAQCGHSADRHNAEAWKQTEPAEQKLNSVWIMPQQSAGLEESAPDTIPPKESGVAYYVDLHGHASKRGCFMYGNSFSDESTQVENMLYPKLISLNSAHFDFQGCNFSEKNMYARDRRDGQSKEGSGRVAIYKASGIIHSYTLECNYNTGRSVNSIPAACHDNGRASPPPPPAFPSRYTVELFEQVGRAMAIAALDMAECNPWPRIVLSEHSSLTNLRAWMLKHVRNSRGLSSTLNVGVNKKRGLRTPPKSHNGLPVSCSENTLSRARSFSTGTSAGGSSSSQQNSPQMKNSPSFPFHGSRPAGLPGLGSSTQKVTHRVLGPVRGKPVWEPLQHVFGCLGHCWGK

SEQ ID NO: 851011 - protein, 816 aa, Homo sapiens
MELRCGGLLFSSRFDSGNLAHVEKVESLSSDGEGVGGGASALTSGIASSPDYEFNVWTRPDCAETEFENGNRSWFYFSVRGGMPGKLIKINIMNMNKQSKLYSQGMAPFVRTLPTRPRWERIRDRPTFEMTETQFVLSFVHRFVEGRGATTFFAFCYPFSYSDCQELLNQLDQRFPENHPTHSSPLDTIYYHRELLCYSLDGLRVDLLTITSCHGLREDREPRLEQLFPDTSTPRPFRFAGKRIFFLSSRVHPGETPSSFVFNGFLDFILRPDDPRAQTLRRLFVFKLIPMLNPDGVVRGHYRTDSRGVNLNRQYLKPDAVLHPAIYGAKAVLLYHHVHSRLNSQSSSEHQPSSCLPPDAPVSDLEKANNLQNEAQCGHSADRHNAEAWKQTEPAEQKLNSVWIMPQQSAGLEESAPDTIPPKESGVAYYVDLHGHASKRGCFMYGNSFSDESTQVENMLYPKLISLNSAHFDFQGCNFSEKNMYARDRRDGQSKEGSGRVAIYKASGIIHSYTLECNYNTGRSVNSIPAACHDNGRASPPPPPAFPSRYTVELFEQVGRAMAIAALDMAECNPWPRIVLSEHSSLTNLRAWMLKHVRNSRGLSSTLNVGVNKKRGLRTPPKSHNGLPVSCSENTLSRARSFSTGTSAGGSSSSQQNSPQMKNSPSFPFHGSRPAGLPGLGSSTQKVTHRVLGPVREPRSQDRRRQQQPLNHRPAGSLAPSPAPTSSGPASSHKLGSCLLPDSFNIPGSSCSLLSSGDKPEAVMVIGKGLLGTGARMPCIKTRLQTCPRRVSARRGPGFPRLGPGWAGAHRRLAEG

SEQ ID NO: 851012 - protein, 886 aa, Homo sapiens
MELRCGGLLFSSRFDSGNLAHVEKVESLSSDGEGVGGGASALTSGIASSPDYEFNVWTRPDCAETEFENGNRSWFYFSVRGGMPGKLIKINIMNMNKQSKLYSQGMAPFVRTLPTRPRWERIRDRPTFEMTETQFVLSFVHRFVEGRGATTFFAFCYPFSYSDCQELLNQLDQRFPENHPTHSSPLDTIYYHRELLCYSLDGLRVDLLTITSCHGLREDREPRLEQLFPDTSTPRPFRFAGKRIFFLSSRVHPGETPSSFVFNGFLDFILRPDDPRAQTLRRLFVFKLIPMLNPDGVVRGHYRTDSRGVNLNRQYLKPDAVLHPAIYGAKAVLLYHHVHSRLNSQSSSEHQPSSCLPPDAPVSDLEKANNLQNEAQCGHSADRHNAEAWKQTEPAEQKLNSVWIMPQQSAGLEESAPDTIPPKESGVAYYVDLHGHASKRGCFMYGNSFSDESTQVENMLYPKLISLNSAHFDFQGCNFSEKNMYARDRRDGQSKEGSGRVAIYKASGIIHSYTLECNYNTGRSVNSIPAACHDNGRASPPPPPAFPSRYTVELFEQVGRAMAIAALDMAECNPWPRIVLSEHSSLTNLRAWMLKHVRNSRGLSSTLNVGVNKKRGLRTPPKSHNGLPVSCSENTLSRARSFSTGTSAGGSSSSQQNSPQMKNSPSFPFHGSRPAGLPGLGSSTQKVTHRVLGPVREPRSQDRRRQQQPLNHRPAGSLAPSPAPTSSGPASSHKLGSCLLPDSFNIPGSSCSLLSSGDKPEAVMVIGKGLLGTGARMPCIKTRLQARPRLGRGSPPTRRGMKGSSGPTSPTPRTRESSELELGSCSATPGLPQARPPRPRSAPAFSPISCSLSDSPSWNCYSRGPLGQPEVCFVPKSPPLTVSPRV

SEQ ID NO: 851013 - protein, 886 aa, Homo sapiens; identical to SEQ ID NO: 851012

SEQ ID NO: 851014 - protein, 787 aa, Homo sapiens [sequence omitted]

SEQ ID NO: 851015 - protein, 662 aa, Homo sapiens
MELRCGGLLFSSRFDSGNLAHVEKVESLSSDGEGVGGGASALTSGIASSPDYEFNVWTRPDCAETEFENGNRSWFYFSVRGGMPGKLIKINIMNMNKQSKLYSQGMAPFVRTLPTRPRWERIRDRPTFEMTETQFVLSFVHRFVEGRGATTFFAFCYPFSYSDCQELLNQLDQRFPENHPTHSSPLDTIYYHRELLCYSLDGLRVDLLTITSCHGLREDREPRLEQLFPDTSTPRPFRFAGKRIFFLSSRVHPGETPSSFVFNGFLDFILRPDDPRAQTLRRLFVFKLIPMLNPDGVVRGHYRTDSRGVNLNRQYLKPDAVLHPAIYGAKAVLLYHHVHSRLNSQSSSEHQPSSCLPPDAPVSDLEKANNLQNEAQCGHSADRHNAEAWKQTEPAEQKLNSVWIMPQQSAGLEESAPDTIPPKESGVAYYVDLHGHASKRGCFMYGNSFSDESTQVENMLYPKLISLNSAHFDFQGCNFSEKNMYARDRRDGQSKEGSGRVAIYKASGIIHSYTLECNYNTGRSVNSIPAACHDNGRASPPPPPAFPSRYTVELFEQVGRAMAIAALDMAECNPWPRIVLSEHSSLTNLRAWMLKHVRNSRGLSSTLNVGVNKKRGLRTPPKSHNGLPVSCSENTLSRARSFSTGTSAGGSSSSQQNSPQMK

SEQ ID NO: 851016 - protein, 717 aa, Homo sapiens; identical to SEQ ID NO: 851010

SEQ ID NO: 851017 - protein, 605 aa, Homo sapiens
GTRLSKLVRIRDRPTCEMTETQFVLSFVHRFVEGRGATTFFAFCYPFSYSDCQELLNQLDQRFPENHPTHSSPLDTIYYHRELLCYSLDGLRVDLLTITSCHGLREDREPRLEQLFPDTSTPRPFRFAGKRIFFLSSRVHPGETPSSFVFNGFLDFILRPDDPRAQTLRRLFVFKLIPMLNPDGVVRGHYRTDSRGVNLNRQYLKPDAVLHPAIYGAKAVLLYHHVHSRLNSQSSSEHQPSSCLPPDAPVSDLEKANNLQNEAQCGHSADRHNAEAWKQTEPAEQKLNSVWIMPQQSAGLEESAPDTIPPKESGVAYYVDLHGHASKRGCFMYGNSFSDESTQVENMLYPKLISLNSAHFDFQGCNFSEKNMYARDRRDGQSKEGSGRVAIYKASGIIHSYTLECNYNTGRSVNSIPAACHDNGRASPPPPPAFPSRYTVELFEQVGRAMAIAALDMAECNPWPRIVLSEHSSLTNLRAWMLKHVRNSRGLSSTLNVGVNKKRGLRTPPKSHNGLPVSCSENTLSRARSFSTGTSAGGSSSSQQNSPQMKNSPSFPFHGSRPAGLPGLGSSTQKVTHRVLGPVRGKPVWEPLQHVFGCLGHCWGK

SEQ ID NO: 851018 - protein, 123 aa, Homo sapiens
MVIGKGLLGTGARMPCIKTRLQARPRLGRGSPPTRRGMKGSSGPTSPTPRTRESSELELGSCSATPGLPQARPPRPRSAPAFSPISCSLSDSPSWNCYSRGPLGQPEVCFVPKSPPLTVSPRV

SEQ ID NO: 851019 - protein, 115 aa, Homo sapiens
MEESSLLAQTLSTQARPRLGRGSPPTRRGMKGSSGPTSPTPRTRESSELELGSCSATPGLPQARPPRPRSAPAFSPISCSLSDSPSWNCYSRGPLGQPEVCFVPKSPPLTVSPRV

SEQ ID NO: 851020 - protein, 192 aa, Homo sapiens
GDRPWEALKGTPPFYYYAFYELVAKGSACLGTPNKCSSAPGTPSQCGEDNGRGILLLVGGASWDSRAGLPCPPPYQVHGLCICPHQSVHTVSAAKTCTRIIHDMQQSLGTPMPAGMNAMLYSAWPYLPQVRPPHIYLSGSASECECHGHVYSCHFDTAVSQSGSPCNMCSVVWGIAGGSKSLKIYCWPRTKG

SEQ ID NO: 851021 - protein, 886 aa, Homo sapiens; identical to SEQ ID NO: 851012

SEQ ID NO: 851022 - protein, 477 aa, Homo sapiens [sequence omitted]

SEQ ID NO: 851023 - protein, 516 aa, Homo sapiens [sequence omitted]

SEQ ID NO: 851024 - protein, 303 aa, Homo sapiens
MELRCGGLLFSSRFDSGNLAHVEKVESLSSDGEGVGGGASALTSGIASSPDYEFNVWTRPDCAETEFENGNRSWFYFSVRGGMPGKLIKINIMNMNKQSKLYSQGMAPFVRTLPTRPRWERIRDRPTFEMTETQFVLSFVHRFVEGRGATTFFAFCYPFSYSDCQELLNQLDQRFPENHPTHSSPLDTIYYHRELLCYSLDGLRVDLLTITSCHGLREDREPRLEQLFPDTSTPRPFRFAGKRIFFLSSRVHPGETPSSFVFNGFLDFILRPDDPRAQTLRRLFVFKLIPMLNPDGVVRGHYR

SEQ ID NO: 851025 - protein, 465 aa, Homo sapiens
MELRCGGLLFSSRFDSGNLAHVEKVESLSSDGEGVGGGASALTSGIASSPDYEFNVWTRPDCAETEFENGNRSWFYFSVRGGMPGKLIKINIMNMNKQSKLYSQGMAPFVRTLPTRPRWERIRDRPTFEMTETQFVLSFVHRFVEGRGATTFFAFCYPFSYSDCQELLNQLDQRFPENHPTHSSPLDTIYYHRELLCYSLDGLRVDLLTITSCHGLREDREPRLEQLFPDTSTPRPFRFAGKRIFFLSSRVHPGETPSSFVFNGFLDFILRPDDPRAQTLRRLFVFKLIPMLNPDGVVRGHYRTDSRGVNLNRQYLKPDAVLHPAIYGAKAVLLYHHVHSRLNSQSSSEHQPSSCLPPDAPVSDLEKANNLQNEAQCGHSADRHNAEAWKQTEPAEQKLNSVWIMPQQSAGLEESAPDTIPPKESGVAYYVDLHGHASKRGCFMYGTYGEKRITQGENIRYTITE

SEQ ID NO: 851026 - protein, 603 aa, Homo sapiens
ICTRSVPGCYVSRGGLEPGLKYPRPSSVTCNGRGATTFFAFCYPFSYSDCQELLNQLDQRFPENHPTHSSPLDTIYYHRELLCYSLDGLRVDLLTITSCHGLREDREPRLEQLFPDTSTPRPFRFAGKRIFFLSSRVHPGETPSSFVFNGFLDFILRPDDPRAQTLRRLFVFKLIPMLNPDGVVRGHYRTDSRGVNLNRQYLKPDAVLHPAIYGAKAVLLYHHVHSRLNSQSSSEHQPSSCLPPDAPVSDLEKANNLQNEAQCGHSADRHNAEAWKQTEPAEQKLNSVWIMPQQSAGLEESAPDTIPPKESGVAYYVDLHGHASKRGCFMYGNSFSDESTQVENMLYPKLISLNSAHFDFQGCNFSEKNMYARDRRDGQSKEGSGRVAIYKASGIIHSYTLECNYNTGRSVNSIPAACHDNGRASPPPPPAFPSRYTVELFEQVGRAMAIAALDMAECNPWPRIVLSEHSSLTNLRAWMLKHVRNSRGLSSTLNVGVNKKRGLRTPPKSHNGLPVSCSENTLSRARSFSTGTSAGGSSSSQQNSPQMKNSPSFPFHGSRPAGLPGLGSSTQKVTHRVLGPVRGKPVWEPLQHVFGCLGHCWGK

SEQ ID NO: 851027 - protein, 102 aa, Homo sapiens
RVNWHLLLCSGLPVSCSENTLSRARSFSTGTSAGGSSSSQQNSPQMKNSPSFPFHGSRPAGLPGLGSSTQKVTHRVLGPVRGKPVWEPLQHVFGCLGHCWGK

SEQ ID NO: 851028 - protein, 626 aa, Homo sapiens; identical to SEQ ID NO: 794046

SEQ ID NO: 851029 - protein, 409 aa, Homo sapiens
MKWHSEDEIRITTWRNRKPPERKMSQNTQDGYTRNWFKVTIPYGIKYDKAWLMNSIQSHCSDRFTPVDFHYVRNRACFFVQDASAASALKDVSYKIYDDENQKICIFVNHSTAPYSVKNKLKPGQMEMLKLTMNKRYNVSQQALDLQNLRFDPDLMGRDIDIILNRRNCMAATLKIIERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQYYSIYDSGDRQGLLGAYHDEACFSLAIPFDPKDSAPSSLCKYFEDSRNMKTLKDPYLKGELLRRTKRDIVDSLSALPKTQHDLSSILVDVWCQTVPSGQ

SEQ ID NO: 851030 - protein, 626 aa, Homo sapiens; identical to SEQ ID NO: 794046

SEQ ID NO: 851031 - protein, 490 aa, Homo sapiens
MCSTLKKCGTYRTEVAECHDHGSTFQGRKKGGSSFRDNFDKRSCHYEHGGYERPPSHCQENDGSVEMRDVHKDQQLRHTPYSIRCERRMKWHSEDEIRITTWRNRKPPERKMSQNTQDGYTRNWFKVTIPYGIKYDKAWLMNSIQSHCSDRFTPVDFHYVRNRACFFVQDASAASALKDVSYKIYDDENQKICIFVNHSTAPYSVKNKLKPGQMEMLKLTMNKRYNVSQQALDLQNLRFDPDLMGRDIDIILNRRNCMAATLKIIERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQYYSIYDSGDRQGLLGAYHDEACFSLAIPFDPKDSAPSSLCKYFEDSRNMKTLKDPYRGQDPRRGLQANLLKGALRCLLCLRSHPLCFLFSPA

SEQ ID NO: 851032 - protein, 345 aa, Homo sapiens
KEFGTSTMEDSGKTFSSEEEEANYWKDLAMTYKQRAENTQEELREFQEGSREYEAELETQLQQIETRNRDLLSENNRLRMELETIKEKFEVQHSEGYRQISALEDDLAQTKAIKDQLQKYIRELEQANDDLERAKRATIMSLEDFEQRLNQAIERNAFLESELDEKENLLESVQRLKDEARDLRQELAVQQKQEKPRTPMPSSVEAERTDTAVQATGSVPSTPIAHRGPSSSLNTPGSFRRGLDDSTGGTPLTPAARISALNIVGDLLRKVGALESKLASCRNLVYDQSPNRTGGPASGRSSKNRDGGERRPSSTSVPLGDKGSVPSNKPLAGGENPPAPGKRHS

SEQ ID NO: 851033 - protein, 386 aa, Homo sapiens
VGQKPGPLREAAVLSARPAWLAGSSVTIASRTRQWHTRGVVDRPVPLVLSIMEDSGKTFSSEEEEANYWKDLAMTYKQRAENTQEELREFQEGSREYEAELETQLQQIETRNRDLLSENNRLRMELETIKEKFEVQHSEGYRQISALEDDLAQTKAIKDQLQKYIRELEQANDDLERAKRATIMSLEDFEQRLNQAIERNAFLESELDEKENLLESVQRLKDEARDLRQELAVQQKQEKPRTPMPSSVEAERTDTAVQATGSVPSTPIAHRGPSSSLNTPGSFRRGLDDSTGGTPLTPAARISALNIVGDLLRKVGALESKLASCRNLVYDQSPNRTGGPASGRSSKNRDGGERRPSSTSVPLGDKGLDTSCRWLSKSTTRSSSSC

SEQ ID NO: 851034 - protein, 384 aa, Homo sapiens
AGAAPPFAAASAAAAALASPPLLGHHATRRVISSPVFTMEDSGKTFSSEEEEANYWKDLAMTYKQRAENTQEELREFQEGSREYEAELETQLQQIETRNRDLLSENNRLRMELETIKEKFEVQHSEGYRQISALEDDLAQTKAIKDQLQKYIRELEQANDDLERAKRATIMSLEDFEQRLNQAIERNAFLESELDEKENLLESVQRLKDEARDLRQELAVQQKQEKPRTPMPSSVEAERTDTAVQATGSVPSTPIAHRGPSSSLNTPGSFRRGLDDSTGGTPLTPAARISALNIVGDLLRKVGALESKLASCRNLVYDQSPNRTGGPASGRSSKNRDGGERRPSSTSVPLGDKGLGKRLEFGKPPSHMSSSPLPSAQGVVKMLL

SEQ ID NO: 851035 - protein, 357 aa, Homo sapiens
AGAAPPFAAASAAAAALASPPLLGHHATRRVISSPVFTMEDSGKTFSSEEEEANYWKDLAMTYKQRAENTQEELREFQEGSREYEAELETQLQQIETRNRDLLSENNRLRMELETIKEKFEVQHSEGYRQISALEDDLAQTKAIKDQLQKYIRELEQANDDLERAKRATIMSLEDFEQRLNQAIERNAFLESELDEKENLLESVQRLKDEARDLRQELAVQQKQEKPRTPMPSSVEAERTDTAVQATGSVPSTPIAHRGPSSSLNTPGSFRRGLDDSTGGTPLTPAARISALNIVGDLLRKVGALESKLASCRNLVYDQSPNRTGGPASGRSSKNRDGGERRPSSTSVPLGDKGREN

SEQ ID NO: 851036 - protein, 400 aa, Homo sapiens
AGAAPPFAAASAAAAALASPPLLGHHATRRVISSPVFTMEDSGKTFSSEEEEANYWKDLAMTYKQRAENTQEELREFQEGSREYEAELETQLQQIETRNRDLLSENNRLRMELETIKVPRRSLNRQCSRWSPLAASSWSLRLNLEKFEVQHSEGYRQISALEDDLAQTKAIKDQLQKYIRELEQANDDLERAKRATIMSLEDFEQRLNQAIERNAFLESELDEKENLLESVQRLKDEARDLRQELAVQQKQEKPRTPMPSSVEAERTDTAVQATGSVPSTPIAHRGPSSSLNTPGSFRRGLDDSTGGTPLTPAARISALNIVGDLLRKVGALESKLASCRNLVYDQSPNRTGGPASGRSSKNRDGGERRPSSTSVPLGDKGLDTSCRWLSKSTTRSSSSC

SEQ ID NO: 851037 - protein, 425 aa, Homo sapiens
AGAAPPFAAASAAAAALASPPLLGHHATRRVISSPVFTMEDSGKTFSSEEEEANYWKDLAMTYKQRAENTQEELREFQEGSREYEAELETQLQQIETRNRDLLSENNRLRMELETIKEKFEVQHSEGYRQISALEDDLAQTKAIKDQLQKYIRELEQANDDLERAKRATIMSLEDFEQRLNQAIERNAFLESELDEKENLLESVQRLKDEARDLRQELAVQQKQEKPRTPMPSSVEAERTDTAVQATGSVPSTPIAHRGPSSSLNTPGSFRRGLDDSTGGTPLTPAARISALNIVGDLLRKVGVGEAPGIWEAAFTHVFIAAAVSPGGSQDVALGKPRKLKVLVLVGHELPLVVQINNQVVQLLLKPVLGLFQFIIRGRLLLVLLGEVLDLLLEPLLPLFQSFHGAGKVLQLLLRVGELQGQRPG

SEQ ID NO: 851038 - protein, 384 aa, Homo sapiens; identical to SEQ ID NO: 851034

SEQ ID NO: 851039 - protein, 384 aa, Homo sapiens; identical to SEQ ID NO: 851034

SEQ ID NO: 851040 - protein, 138 aa, Homo sapiens [sequence omitted]

SEQ ID NO: 851041 - protein, 109 aa, Homo sapiens
MDLRQELAVQQKQEKPRTPMPSSVEAERTDTAVQATGSVPSTPIAHRGPSSSLNTPGSFRRGTGVQTRFLPEPRVRSVPKPNRWPSLWAEQQEQRWRGETAKQHQRAFG

SEQ ID NO: 851042 - protein, 104 aa, Homo sapiens
VGQKPGPLREAAVLSARPAWLAGSSVTIASRTRQWHTRGVVDRPVPLVLSIMEDSGKTFSSEEEEANYWKDLAMTYKQRAENTQEELREFQEGSREYEVNFLYF

SEQ ID NO: 851043 - protein, 105 aa, Homo sapiens
AVTPGGCVLLCLAFSEVLSHSLSVCVVLQEKFEVQHSEGYRQISALEDDLAQTKAIKDQLQKYIRELEQANDDLERAKRYGWKGKARVGDSPLCFLSPAAGYWAL

SEQ ID NO: 851044 - protein, 373 aa, Homo sapiens
AGAAPPFAAASAAAAALASPPLLGHHATRRVISSPVFTMEDSGKTFSSEEEEANYWKDLAMTYKQRAENTQEELREFQEGSREYEAELETQLQQIETRNRDLLSENNRLRMELETIKEKFEVQHSEGYRQISALEDDLAQTKAIKDQLQKYIRELEQANDDLERAKRATIMSLEDFEQRLNQAIERNAFLESELDEKENLLESVQRLKDEARDLRQELAVQQKQEKPRTPMPSSVEAERTDTAVQATGSVPSTPIAHRGPSSSLNTPGSFRRGLDDSTGGTPLTPAARISALNIVGDLLRKVGALESKLASCRNLVYDQSPNRTGGPASGRSSKNRDGGERRPSSTSVPLGDKGLDTSCRWLSKSTTRSSSSC

SEQ ID NO: 851045 - protein, 335 aa, Homo sapiens
MEDSGKTFSSEEEEANYWKDLAMTYKQRAENTQEELREFQEGSREYEAELETQLQQIETRNRDLLSENNRLRMELETIKEKFEVQHSEGYRQISALEDDLAQTKAIKDQLQKYIRELEQANDDLERAKRATIMSLEDFEQRLNQAIERNAFLESELDEKENLLESVQRLKDEARDLRQELAVQQKQEKPRTPMPSSVEAERTDTAVQATGSVPSTPIAHRGPSSSLNTPGSFRRGLDDSTGGTPLTPAARISALNIVGDLLRKVGALESKLASCRNLVYDQSPNRTGGPASGRSSKNRDGGERRPSSTSVPLGDKGLDTSCRWLSKSTTRSSSSC

SEQ ID NO: 851046 - protein, 383 aa, Homo sapiens
AGAAPPFAAASAAAAALASPPLLGHHATRRVISSPVFTMEDSGKTFSSEEEEANYWKDLAMTYKQRAENTQEELREFQEGSREYEAELETQLQQIETRNRDLLSENNRLRMELETIKEKFEVQHSEGYRQISALEDDLAQTKAIKDQLQKYIRELEQANDDLERAKRATIMSLEDFEQRLNQAIERNAFLESELDEKENLLESVQRLKDEARDLRQELAVQQKQEKPRTPMPSSVEAERTDTAVQATGSVPSTPIAHRGPSSSLNTPGSFRRGLDDSTGGTPLTPAARISALNIVGDLLRKVGVGHELPLVVQINNQVVQLLLKPVLGLFQFIIRGRLLLVLLGEVLDLLLEPLLPLFQSFHGAGKVLQLLLRVGELQGQRPG

SEQ ID NO: 851047 - protein, 203 aa, Homo sapiens [sequence omitted]

SEQ ID NO: 851048 - protein, 357 aa, Homo sapiens; identical to SEQ ID NO: 851035

SEQ ID NO: 851049 - protein, 357 aa, Homo sapiens; identical to SEQ ID NO: 851035

SEQ ID NO: 851050 - protein, 111 aa, Homo sapiens
MEDSGKTFSSEEEEANYWKDLAMTYKQRAENTQEELREFQEGSREYEAELETQLQQIETRNRDLLSENNRLRMELETIKEKFEVQHSEGYRQISALEDDLAQTKAIKDQLL

SEQ ID NO: 851051 - protein, 104 aa, Homo sapiens; identical to SEQ ID NO: 851042

SEQ ID NO: 851052 - protein, 70 aa, Homo sapiens
PMPSSVEAERTDTAVQATGSVPSTPIAHRGPSSSLNTPGSFRRGKGSGNCRIFSVHKVFLGKNLGWVLGV

SEQ ID NO: 851053 - protein, 204 aa, Homo sapiens
VCRLREKMAALGEPVRLERDICRAIELLEKLQRSGEVPPQKLQALQRVLQSEFCNAVREVYEHVYETVDISSSPEVRANATAKATVAAFAASEGHSHPRVVELPKTEEGLGFNIMGGKEQNSPIYISRIIPGGIADRHGGLKRGDQLLSVNGVSVEGEHHEKAVELLKAAQGKVKLVVRYTPKVLEEMESRFEKMRSAKRRQQT

SEQ ID NO: 851054 - protein, 204 aa, Homo sapiens; identical to SEQ ID NO: 851053

SEQ ID NO: 851055 - protein, 1480 aa, Homo sapiens
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMMIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILNEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECLFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 851056 - protein, 1432 aa, Homo sapiens
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMMIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILNEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTLKSVTGPSGKLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 851057 - protein, 1432 aa, Homo sapiens; identical to SEQ ID NO: 851056

SEQ ID NO: 851058 - protein, 1200 aa, Homo sapiens
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMMIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILNEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTLKSVTGPSGKLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVRFEHCLLC

SEQ ID NO: 851059 - protein, 1661 aa, Homo sapiens
MDGQTLRKAERSWSCSREKKEGYAKDMVTDFDEKHDEYLILLQQRNRILKHLKSKDPVQLRLEHLEQGFSVYVNGANSELKSSPRKAIHSDFSRSASHTEGTHDYGRRTLFREAEEALRRSSRTAPSKVQRRGWHQKSVQIRTEAGPRLHIEPPVDYSDDFELCGDVTLQANNTSEDRPQDTKSPTSTKPCGFNFSLLNACGHSDPSSSVDKERILLTIQDVMELRRSLELSVNLQRKQKDCSSDEYDSIEEDILSEPEPEDPALVGHPRHDRPPSSGDWTQKDVHGEQETEGRSSPGPDTLVVLEFNPASKSHKRERNLSAKRKDNAEVFVPTKPEPNLTPQAPAVFPDQERMCSRPGSRRERPLSATRKTLCEAEYPEEDASAVLQAIQVENAALQRALLSRKAEQPASPLQDAEGPPAKPWTSLLEEKEETLELLPITTATTTQEPAGAAGGARAINQAMDRIGLLGSRQQQKLLKVLQAVESDSAHLGRVVSPTKEQVSDTEDKQRMRADEIKDAIYVTMEILSNWGNSWWVGLTEVEFFDLNDTKLYVSPHDVDIRNTATPGELGRLVNRNLAGKKDSSPWTCPFHPPLQLFFVIRNTRQLGDFHLAKIKVRNYWTADGDLDIGAKNVKLYVNRNLIFNGKLDKGDREAPADHSILVDQKNEKSEQLEEAMNAHSEESKGTHEMAGASGDKELGLGCSPPAETLADAKLSSQGNVSGKRKNSTNCRKDSLSQLEEYLRLSAVPTSMGDMPSAPATSPPVKCPPVHEEPSLIQQLENLMGRKICEPPGKTPSWLQPSPTGKDRKQGGRKPKPLWLSPEKPLAWKGRLPSDDVIGEGPGETEARDKGLRHEPGWGTSRSVNTKERPQRATTKVHSDDSDIFNQPPNRERPASGRRGSRKDAGSSSHGDDQPASREDTWSSRTPSRSRWRSEQEHTLHESWSSLSAFDRSHRGRISNTELPGDILDELLQQKSSRHSDLPPSKKGEQPGLSRGQDGYSGETDAGGDFKIPVLPYGQRLVIDIKSTWGDRHYVGLNGIEIFSSKGEPVQISNIKADPPDINILPAYGKDPRVVTNLIDGVNRTQDDMHVWLAPFTRGRSHSITIDFTHPCHVALIRIWNYNKSRIHSFRGVKDITMLLDTQCIFEGEIAKASGTLAGAPEHFGDTILFTTDDDILEAIFYSDEMFDLDVGSLDSLQDEEAMRRPSTADGEGDERPFTQAGLGADERIPELELPSSSPVPQVTTPEPGIYHGICLQLNFTASWGDLHYLGLTGLEVVGKEGQALPIHLHQISASPRDLNELPEYSDDSRTLDKLIDGTNITMEDEHMWLIPFSPGLDHVVTIRLDRAESIAGLRFWNYNKSPEDTYRGAKIVHVSLDGLCVSPPEGFLIRKGPGNCHFDFAQEILFVDYLRAQLLPQPARRLDMRSLECASMDYEAPLMPCGFIFQFQLLTSWGDPYYIGLTGLELYDERGEKIPLSENNIAAFPDSVNSLEGVGGDVRTPDKLIDQVNDTSDGRHMWLAPILPGLVNRVYVIFDLPTTVSMIKLWNYAKTPHRGVKEFGLLVDDLLVYNGILAMVSHLVGGILPTCEPTVPYHTILFTEDRDIRHQEKHTTISNQAEDQDVQMMNENQIITNAKRKQSVVDPALRPKTCISEKETRRRRC

SEQ ID NO: 851060 - protein, 1635 aa, Homo sapiens
MTVRLCERPREAGPAHERKRRILKHLKSKDPVQLRLEHLEQGFSVYVNGANSELKSSPRKAIHSDFSRSASHTEGTHDYGRRTLFREAEEALRRSSRTAPSKVQRRGWHQKSVQIRTEAGPRLHIEPPVDYSDDFELCGDVTLQANNTSEDRPQDTKSPTSTKPCGFNFSLLNACGHSDPSSSVDKERILLTIQDVMELRRSLELSVNLQRKQKDCSSDEYDSIEEDILSEPEPEDPALVGHPRHDRPPSSGDWTQKDVHGEQETEGRSSPGPDTLVVLEFNPASKSHKRERNLSAKRKDNAEVFVPTKPEPNLTPQAPAVFPDQERMCSRPGSRRERPLSATRKTLCEAEYPEEDASAVLQAIQVENAALQRALLSRKAEQPASPLQDAEGPPAKPWTSLLEEKEETLELLPITTATTTQEPAGAAGGARAINQAMDRIGLLGSRQQQKLLKVLQAVESDSAHLGRVVSPTKEQVSDTEDKQRMRADEIKDAIYVTMEILSNWGNSWWVGLTEVEFFDLNDTKLYVSPHDVDIRNTATPGELGRLVNRNLAGKKDSSPWTCPFHPPLQLFFVIRNTRQLGDFHLAKIKVRNYWTADGDLDIGAKNVKLYVNRNLIFNGKLDKGDREAPADHSILVDQKNEKSEQLEEAMNAHSEESKGTHEMAGASGDKELGLGCSPPAETLADAKLSSQGNVSGKRKNSTNCRKDSLSQLEEYLRLSAVPTSMGDMPSAPATSPPVKCPPVHEEPSLIQQLENLMGRKICEPPGKTPSWLQPSPTGKDRKQGGRKPKPLWLSPEKPLAWKGRLPSDDVIGEGPGETEARDKGLRHEPGWGTSRSVNTKERPQRATTKVHSDDSDIFNQPPNRERPASGRRGSRKDAGSSSHGDDQPASREDTWSSRTPSRSRWRSEQEHTLHESWSSLSAFDRSHRGRISNTELPGDILDELLQQKSSRHSDLPPSKKGEQPGLSRGQDGYSGETDAGGDFKIPVLPYGQRLVIDIKSTWGDRHYVGLNGIEIFSSKGEPVQISNIKADPPDINILPAYGKDPRVVTNLIDGVNRTQDDMHVWLAPFTRGRSHSITIDFTHPCHVALIRIWNYNKSRIHSFRGVKDITMLLDTQCIFEGEIAKASGTLAGAPEHFGDTILFTTDDDILEAIFYSDEMFDLDVGSLDSLQDEEAMRRPSTADGEGDERPFTQAGLGADERIPELELPSSSPVPQVTTPEPGIYHGICLQLNFTASWGDLHYLGLTGLEVVGKEGQALPIHLHQISASPRDLNELPEYSDDSRTLDKLIDGTNITMEDEHMWLIPFSPGLDHVVTIRLDRAESIAGLRFWNYNKSPEDTYRGAKIVHVSLDGLCVSPPEGFLIRKGPGNCHFDFAQEILFVDYLRAQLLPQPARRLDMRSLECASMDYEAPLMPCGFIFQFQLLTSWGDPYYIGLTGLELYDERGEKIPLSENNIAAFPDSVNSLEGVGGDVRTPDKLIDQVNDTSDGRHMWLAPILPGLVNRVYVIFDLPTTVSMIKLWNYAKTPHRGVKEFGLLVDDLLVYNGILAMVSHLVGGILPTCEPTVPYHTILFTEDRDIRHQEKHTTISNQAEDQDVQMMNENQIITNAKRKQSVVDPALRPKTCISEKETRRRRC

SEQ ID NO: 851061 - protein, 1334 aa, Homo sapiens
AEALPFPSPESSHLVNEVSGSSFLEEVPGQASFLFAIEKLAGMVWKESIPPRPGSRRERPLSATRKTLCEAEYPEEDASAVLQAIQVENAALQRALLSRKAEQPASPLQLLPITTATTTQEPAGAAGGARAINQAMDRIGLLGSRQQQKLLKVLQAVESDSAHLGRVVSPTKEQVSDTEDKQRMRADEIKDAIYVTMEILSNWGNSWWVGLTEVEFFDLNDTKLYVSPHDVDIRNTATPGELGRLVNRNLAGKKDSSPWTCPFHPPLQLFFVIRNTRQLGDFHLAKIKVRNYWTADGDLDIGAKNVKLYVNRNLIFNGKLDKGDREAPADHSILVDQKNEKSEQLEEAMNAHSEESKGTHEMAGASGDKELGLGCSPPAETLADAKLSSQGNVSGKRKNSTNCRKDSLSQLEEYLRLSAVPTSMGDMPSAPATSPPVKCPPVHEEPSLIQQLENLMGRKICEPPGKTPSWLQPSPTGKDRKQGGRKPKPLWLSPEKPLAWKGRLPSDDVIGEGPGETEARDKGLRHEPGWGTSRSVNTKERPQRATTKVHSDDSDIFNQPPNRERPASGRRGSRKDAGSSSHGDDQPASREDTWSSRTPSRSRWRSEQEHTLHESWSSLSAFDRSHRGRISNTELPGDILDELLQQKSSRHSDLPPSKKGEQPGLSRGQDGYSGETDAGGDFKIPVLPYGQRLVIDIKSTWGDRHYVGLNGIEIFSSKGEPVQISNIKADPPDINILPAYGKDPRVVTNLIDGVNRTQDDMHVWLAPFTRGRSHSITIDFTHPCHVALIRIWNYNKSRIHSFRGVKDITMLLDTQCIFEGEIAKASGTLAGAPEHFGDTILFTTDDDILEAIFYSDEMFDLDVGSLDSLQDEEAMRRPSTADGEGDERPFTQAGLGADERIPELELPSSSPVPQVTTPEPGIYHGICLQLNFTASWGDLHYLGLTGLEVVGKEGQALPIHLHQISASPRDLNELPEYSDDSRTLDKLIDGTNITMEDEHMWLIPFSPGLDHVVTIRLDRAESIAGLRFWNYNKSPEDTYRGAKIVHVSLDGLCVSPPEGFLIRKGPGNCHFDFAQEILFVDYLRAQLLPQPARRLDMRSLECASMDYEAPLMPCGFIFQFQLLTSWGDPYYIGLTGLELYDERGEKIPLSENNIAAFPDSVNSLEGVGGDVRTPDKLIDQVNDTSDGRHMWLAPILPGLVNRVYVIFDLPTTVSMIKLWNYAKTPHRGVKEFGLLVDDLLVYNGILAMVSHLVGGILPTCEPTVPYHTILFTEDRDIRHQEKHTTISNQAEDQDVQMMNENQIITNAKRKQSVVDPALRPKTCISEKETRRRRC

SEQ ID NO: 851062 - protein, 442 aa, Homo sapiens
SASPTHVQIPELELPSSSPVPQVTTPEPGIYHGICLQLNFTASWGDLHYLGLTGLEVVGKEGQALPIHLHQISASPRDLNELPEYSDDSRTLDKLIDGTNITMEDEHMWLIPFSPGLDHVVTIRLDRAESIAGLRFWNYNKSPEDTYRGAKIVHVSLDGLCVSPPEGFLIRKGPGNCHFDFAQEILFVDYLRAQLLPQPARRLDMRSLECASMDYEAPLMPCGFIFQFQLLTSWGDPYYIGLTGLELYDERGEKIPLSENNIAAFPDSVNSLEGVGGDVRTPDKLIDQVNDTSDGRHMWLAPILPGLVNRVYVIFDLPTTVSMIKLWNYAKTPHRGVKEFGLLVDDLLVYNGILAMVSHLVGGILPTCEPTVPYHTILFTEDRDIRHQEKHTTISNQAEDQDVQMMNENQIITNAKRKQSVVDPALRPKTCISEKETRRRRC

SEQ ID NO: 851063 - protein, 67 aa, Homo sapiens
LLTSVQTERARWEEGTREDSPGYYQSDRWLWLQGKEIPCSSGLATGSPGHPPSCLCCETQQSRAHDH

SEQ ID NO: 851064 - protein, 1674 aa, Homo sapiens
MDGQTLRKAERSWSCSREKKEGYAKDMVTDFDEKHDEYLILLQQRNRILKHLKSKDPVQLRLEHLEQGFSVYVNGANSELKSSPRKAIHSDFSRSASHTEGTHDYGRRTLFREAEEALRRSSRTAPSKVQRRGWHQKSVQIRTEAGPRLHIEPPVDYSDDFELCGDVTLQANNTSEDRPQDTKSPTSTKPCGFNFSLLNACGHSDPSSSVDKERILLTIQDVMELRRSLELSVNLQRKQKDCSSDEYDSIEEDILSEPEPEDPALVGHPRHDRPPSSGDWTQKDVHGEQETEGRSSPGPDTLVVLEFNPASKSHKRERNLSAKRKDNAEVFVPTKPEPNLTPQAPAVFPDQERMCSRPGSRRERPLSATRKTLCEAEYPEEDASAVLQAIQVENAALQRALLSRKAEQPASPLQDAEGPPAKPWTSLLEEKEETLELLPITTATTTQEPAGAAGGARAINQAMDRIGLLGSRQQQKLLKVLQAVESDSAHLGRVVSPTKEQVSDTEDKQRMRADEIKDAIYVTMEILSNWGNSWWVGLTEVEFFDLNDTKLYVSPHDVDIRNTATPGELGRLVNRNLAGKKDSSPWTCPFHPPLQLFFVIRNTRQLGDFHLAKIKVRNYWTADGDLDIGAKNVKLYVNRNLIFNGKLDKGDREAPADHSILVDQKNEKSEQLEEAMNAHSEESKGTHEMAGASGDKELGLGCSPPAETLADAKLSSQGNVSGKRKNSTNCRKDSLSQLEEYLRLSAVPTSMGDMPSAPATSPPVKCPPVHEEPSLIQQLENLMGRKICEPPGKTPSWLQPSPTGKDRKQGGRKPKPLWLSPEKPLAWKGRLPSDDVIGEGPGETEARDKGLRHEPGWGTSRSVNTKERPQRATTKVHSDDSDIFNQPPNRERPASGRRGSRKDAGSSSHGDDQPASREDTWSSRTPSRSRWRSEQEHTLHESWSSLSAFDRSHRGRISNTELPGDILDELLQQKSSRHSDLPPSKKGEQPGLSRGQDGYSGETDAGGDFKIPVLPYGQRLVIDIKSTWGDRHYVGLNGIEIFSSKGEPVQISNIKADPPDINILPAYGKDPRVVTNLIDGVNRTQDDMHVWLAPFTRGRSHSITIDFTHPCHVALIRIWNYNKSRIHSFRGVKDITMLLDTQCIFEGEIAKASGTLAGAPEHFGDTILFTTDDDILEAIFYSDEMFDLDVGSLDSLQDEEAMRRPSTADGEGDERPFTQAGLGADERIPELELPSSSPVPQVTTPEPGIYHGICLQLNFTASWGDLHYLGLTGLEVVGKEGQALPIHLHQISASPRDLNELPEYSDDSRTLDKLIDGTNITMEDEHMWLIPFSPGLDHVVTIRLDRAESIAGLRFWNYNKSPEDTYRGAKIVHVSLDGLCVSPPEGFLIRKGPGNCHFDFAQEILFVDYLRAQLLPQPARRLDMRSLECASMDYEAPLMPCGFIFQFQLLTSWGDPYYIGLTGLELYDERGEKIPLSENNIAAFPDSVNSLEGVGGDVRTPDKLIDQVNDTSDGRHMWLAPILPGLVNRVYVIFDLPTTVSMIKLWNYAKTPHRGVKEFGLLVDDLLVYNGILAMVSHLVGGILPTCEPTVPYHTILFTEDRDIRHQEKHTTISNQAEDQDVQMMNENQIITNAKRKQSVVDPALRPKTCIEEEEESTEGLARLESRRGWARLA

SEQ ID NO: 851065 - protein, 146 aa, Homo sapiens
MDGQTLRKAERSWSCSREKKEGYAKDMVTDFDEKHDEYLILLQQRNRILKHLKSKDPVQLRLEHLEQGFSVYVNGANSELKSSPRKAIHSDFSRSASHTEGTHDYGRRTLFREAEEALRRSSRTAPSKVQRRGWHQVWRLWPQPTL

SEQ ID NO: 851066 - protein, 1618 aa, Homo sapiens
MDGQTLRKAERSWSCSREKKEGYAKDMVTDFDEKHDEYLILLQQRNRILKHLKSKDPVQLRLEHLEQGFSVYVNGANSELKSSPRKAIHSDFSRSASHTEGTHDYGRRTLFREAEEALRRSSRTAPSKVQRRGWHQKSVQIRTEAGPRLHIEPPVDYSDDFELCGDVTLQANNTSEDRPQELRRSLELSVNLQRKQKDCSSDEYDSIEEDILSEPEPEDPALVGHPRHDRPPSSGDWTQKDVHGEQETEGRSSPGPDTLVVLEFNPASKSHKRERNLSAKRKDNAEVFVPTKPEPNLTPQAPAVFPDQERMCSRPGSRRERPLSATRKTLCEAEYPEEDASAVLQAIQVENAALQRALLSRKAEQPASPLQDAEGPPAKPWTSLLEEKEETLELLPITTATTTQEPAGAAGGARAINQAMDRIGLLGSRQQQKLLKVLQAVESDSAHLGRVVSPTKEQVSDTEDKQRMRADEIKDAIYVTMEILSNWGNSWWVGLTEVEFFDLNDTKLYVSPHDVDIRNTATPGELGRLVNRNLAGKKDSSPWTCPFHPPLQLFFVIRNTRQLGDFHLAKIKVRNYWTADGDLDIGAKNVKLYVNRNLIFNGKLDKGDREAPADHSILVDQKNEKSEQLEEAMNAHSEESKGTHEMAGASGDKELGLGCSPPAETLADAKLSSQGNVSGKRKNSTNCRKDSLSQLEEYLRLSAVPTSMGDMPSAPATSPPVKCPPVHEEPSLIQQLENLMGRKICEPPGKTPSWLQPSPTGKDRKQGGRKPKPLWLSPEKPLAWKGRLPSDDVIGEGPGETEARDKGLRHEPGWGTSRSVNTKERPQRATTKVHSDDSDIFNQPPNRERPASGRRGSRKDAGSSSHGDDQPASREDTWSSRTPSRSRWRSEQEHTLHESWSSLSAFDRSHRGRISNTELPGDILDELLQQKSSRHSDLPPSKKGEQPGLSRGQDGYSGETDAGGDFKIPVLPYGQRLVIDIKSTWGDRHYVGLNGIEIFSSKGEPVQISNIKADPPDINILPAYGKDPRVVTNLIDGVNRTQDDMHVWLAPFTRGRSHSITIDFTHPCHVALIRIWNYNKSRIHSFRGVKDITMLLDTQCIFEGEIAKASGTLAGAPEHFGDTILFTTDDDILEAIFYSDEMFDLDVGSLDSLQDEEAMRRPSTADGEGDERPFTQAGLGADERIPELELPSSSPVPQVTTPEPGIYHGICLQLNFTASWGDLHYLGLTGLEVVGKEGQALPIHLHQISASPRDLNELPEYSDDSRTLDKLIDGTNITMEDEHMWLIPFSPGLDHVVTIRLDRAESIAGLRFWNYNKSPEDTYRGAKIVHVSLDGLCVSPPEGFLIRKGPGNCHFDFAQEILFVDYLRAQLLPQPARRLDMRSLECASMDYEAPLMPCGFIFQFQLLTSWGDPYYIGLTGLELYDERGEKIPLSENNIAAFPDSVNSLEGVGGDVRTPDKLIDQVNDTSDGRHMWLAPILPGLVNRVYVIFDLPTTVSMIKLWNYAKTPHRGVKEFGLLVDDLLVYNGILAMVSHLVGGILPTCEPTVPYHTILFTEDRDIRHQEKHTTISNQAEDQDVQMMNENQIITNAKRKQSVVDPALRPKTCISEKETRRRRC

SEQ ID NO: 851067 - protein, 1526 aa, Homo sapiens
MKSVQIRTEAGPRLHIEPPVDYSDDFELCGDVTLQANNTSEDRPQDTKSPTSTKPCGFNFSLLNACGHSDPSSSVDKERILLTIQDVMELRRSLELSVNLQRKQKDCSSDEYDSIEEDILSEPEPEDPALVGHPRHDRPPSSGDWTQKDVHGEQETEGRSSPGPDTLVVLEFNPASKSHKRERNLSAKRKDNAEVFVPTKPEPNLTPQAPAVFPDQERMCSRPGSRRERPLSATRKTLCEAEYPEEDASAVLQAIQVENAALQRALLSRKAEQPASPLQDAEGPPAKPWTSLLEEKEETLELLPITTATTTQEPAGAAGGARAINQAMDRIGLLGSRQQQKLLKVLQAVESDSAHLGRVVSPTKEQVSDTEDKQRMRADEIKDAIYVTMEILSNWGNSWWVGLTEVEFFDLNDTKLYVSPHDVDIRNTATPGELGRLVNRNLAGKKDSSPWTCPFHPPLQLFFVIRNTRQLGDFHLAKIKVRNYWTADGDLDIGAKNVKLYVNRNLIFNGKLDKGDREAPADHSILVDQKNEKSEQLEEAMNAHSEESKGTHEMAGASGDKELGLGCSPPAETLADAKLSSQGNVSGKRKNSTNCRKDSLSQLEEYLRLSAVPTSMGDMPSAPATSPPVKCPPVHEEPSLIQQLENLMGRKICEPPGKTPSWLQPSPTGKDRKQGGRKPKPLWLSPEKPLAWKGRLPSDDVIGEGPGETEARDKGLRHEPGWGTSRSVNTKERPQRATTKVHSDDSDIFNQPPNRERPASGRRGSRKDAGSSSHGDDQPASREDTWSSRTPSRSRWRSEQEHTLHESWSSLSAFDRSHRGRISNTELPGDILDELLQQKSSRHSDLPPSKKGEQPGLSRGQDGYSGETDAGGDFKIPVLPYGQRLVIDIKSTWGDRHYVGLNGIEIFSSKGEPVQISNIKADPPDINILPAYGKDPRVVTNLIDGVNRTQDDMHVWLAPFTRGRSHSITIDFTHPCHVALIRIWNYNKSRIHSFRGVKDITMLLDTQCIFEGEIAKASGTLAGAPEHFGDTILFTTDDDILEAIFYSDEMFDLDVGSLDSLQDEEAMRRPSTADGEGDERPFTQAGLGADERIPELELPSSSPVPQVTTPEPGIYHGICLQLNFTASWGDLHYLGLTGLEVVGKEGQALPIHLHQISASPRDLNELPEYSDDSRTLDKLIDGTNITMEDEHMWLIPFSPGLDHVVTIRLDRAESIAGLRFWNYNKSPEDTYRGAKIVHVSLDGLCVSPPEGFLIRKGPGNCHFDFAQEILFVDYLRAQLLPQPARRLDMRSLECASMDYEAPLMPCGFIFQFQLLTSWGDPYYIGLTGLELYDERGEKIPLSENNIAAFPDSVNSLEGVGGDVRTPDKLIDQVNDTSDGRHMWLAPILPGLVNRVYVIFDLPTTVSMIKLWNYAKTPHRGVKEFGLLVDDLLVYNGILAMVSHLVGGILPTCEPTVPYHTILFTEDRDIRHQEKHTTISNQAEDQDVQMMNENQIITNAKRKQSVVDPALRPKTCISEKETRRRRC

SEQ ID NO: 851068 - protein, 1199 aa, Homo sapiens
MDRIGLLGSRQQQKLLKVLQAVESDSAHLGRVVSPTKEQVSDTEDKQRMRADEIKDAIYVTMEILSNWGNSWWVGLTEVEFFDLNDTKLYVSPHDVDIRNTATPGELGRLVNRNLAGKKDSSPWTCPFHPPLQLFFVIRNTRQLGDFHLAKIKVRNYWTADGDLDIGAKNVKLYVNRNLIFNGKLDKGDREAPADHSILVDQKNEKSEQLEEAMNAHSEESKGTHEMAGASGDKELGLGCSPPAETLADAKLSSQGNVSGKRKNSTNCRKDSLSQLEEYLRLSAVPTSMGDMPSAPATSPPVKCPPVHEEPSLIQQLENLMGRKICEPPGKTPSWLQPSPTGKDRKQGGRKPKPLWLSPEKPLAWKGRLPSDDVIGEGPGETEARDKGLRHEPGWGTSRSVNTKERPQRATTKVHSDDSDIFNQPPNRERPASGRRGSRKDAGSSSHGDDQPASREDTWSSRTPSRSRWRSEQEHTLHESWSSLSAFDRSHRGRISNTELPGDILDELLQQKSSRHSDLPPSKKGEQPGLSRGQDGYSGETDAGGDFKIPVLPYGQRLVIDIKSTWGDRHYVGLNGIEIFSSKGEPVQISNIKADPPDINILPAYGKDPRVVTNLIDGVNRTQDDMHVWLAPFTRGRSHSITIDFTHPCHVALIRIWNYNKSRIHSFRGVKDITMLLDTQCIFEGEIAKASGTLAGAPEHFGDTILFTTDDDILEAIFYSDEMFDLDVGSLDSLQDEEAMRRPSTADGEGDERPFTQAGLGADERIPELELPSSSPVPQVTTPEPGIYHGICLQLNFTASWGDLHYLGLTGLEVVGKEGQALPIHLHQISASPRDLNELPEYSDDSRTLDKLIDGTNITMEDEHMWLIPFSPGLDHVVTIRLDRAESIAGLRFWNYNKSPEDTYRGAKIVHVSLDGLCVSPPEGFLIRKGPGNCHFDFAQEILFVDYLRAQLLPQPARRLDMRSLECASMDYEAPLMPCGFIFQFQLLTSWGDPYYIGLTGLELYDERGEKIPLSENNIAAFPDSVNSLEGVGGDVRTPDKLIDQVNDTSDGRHMWLAPILPGLVNRVYVIFDLPTTVSMIKLWNYAKTPHRGVKEFGLLVDDLLVYNGILAMVSHLVGGILPTCEPTVPYHTILFTEDRDIRHQEKHTTISNQAEDQDVQMMNENQIITNAKRKQSVVDPALRPKTCISEKETRRRRC

SEQ ID NO: 851069 - protein, 120 aa, Homo sapiens
MIKLWNYAKTPHRGVKEFGLLVDDLLVYNGILAMVSHLVGGILPTCEPTVPYHTILFTEDRDIRHQEKHTTISNQAEDQDVQMMNENQIITNAKRKQSVVDPALRPKTCISEKETRRRRC

SEQ ID NO: 851070 - protein, 633 aa, Homo sapiens
MDGQTLRKAERSWSCSREKKEGYAKDMVTDFDEKHDEYLILLQQRNRILKHLKSKDPVQLRLEHLEQGFSVYVNGANSELKSSPRKAIHSDFSRSASHTEGTHDYGRRTLFREAEEALRRSSRTAPSKVQRRGWHQKSVQIRTEAGPRLHIEPPVDYSDDFELCGDVTLQANNTSEDRPQDTKSPTSTKPCGFNFSLLNACGHSDPSSSVDKERILLTIQDVMELRRSLELSVNLQRKQKDCSSDEYDSIEEDILSEPEPEDPALVGHPRHDRPPSSGDWTQKDVHGEQETEGRSSPGPDTLVVLEFNPASKSHKRERNLSAKRKDNAEVFVPTKPEPNLTPQAPAVFPDQERMCSRPGSRRERPLSATRKTLCEAEYPEEDASAVLQAIQVENAALQRALLSRKAEQPASPLQDAEGPPAKPWTSLLEEKEETLELLPITTATTTQEPAGAAGGARAINQAMDRIGLLGSRQQQKLLKVLQAVESDSAHLGRVVSPTKEQVSDTEDKQRMRADEIKDAIYVTMEILSNWGNSWWVGLTEVEFFDLNDTKLYVSPHDVDIRNTATPGELGRLVNRNLAGKKDSSPWTCPFHPPLQLFFVIRNTRQLGDFHLAKIKVRNYWTADGDLDSWLPST

SEQ ID NO: 851071 - protein, 117 aa, Homo sapiens
AGCPVAALWPPVAVRLPEAVPSGLSLLGRGETVSLPLQQAPSQRPAVLGERPVAIPGLSRQSWVFSGESCFHREARLSVVPASSPAFLETRVIFLDYFCVSRKHFSNSPTLWYLPEM

SEQ ID NO: 851072 - protein, 244 aa, Homo sapiens
SGETPSHGSRFRFGLCIFAKVSDVKRLEMDDIADRMRMDAGEVTLVNHNSVFKTHLLPQTGFPEDQLSLSDQQILSSRQGHLDRSFTCSTRSAAYNPSYYSDDDLIQDFLWMDCCCKIADKYLLAMTFVYFKRAKFTISEHTRINFFIALYLANTVEEDEEETKYEIFPWALGKNWRKLFPNFLKLRDQLWDRIDYRAIVSRRCCEEVMAIAPSHYIWQRERSVHHSGAVRNYNRDEVQLPRGP

SEQ ID NO: 851073 - protein, 668 aa, Homo sapiens
SGRGSRFRFGLCIFAKVSDVKRLEMDDIADRMRMDAGEVTLVNHNSVFKTHLLPQTGFPEDQLSLSDQQILSSRQGHLDRSFTCSTRSAAYNPSYYSDNPSSDSFLGSGDLRTFGQSANGQWRNSTPSSSSSLQKSRNSRSLYLETRKTSSGLSNSFAGKSNHHCHVSAYEKSFPIKPVPSPSWSGSCRRSLLSPKKTQRRHVSTAEETVQEEEREIYRQLLQMVTGKQFTIAKPTTHFPLHLSRCLSSSKNTLKDSLFKNGNSCASQIIGSDTSSSGSASILTNQEQLSHSVYSLSSYTPDVAFGSKDSGTLHHPHHHHSVPHQPDNLAASNTQSEGSDSVILLKVKDSQTPTPSSTFFQAELWIKELTSVYDSRARERLRQIEEQKALALQLQNQRLQEREHSVHDSVELHLRVPLEKEIPVTVVQETQKKGHKLTDSEDEFPEITEEMEKEIKNVFRNGNQDEVLSEAFRLTITRKDIQTLNHLNWLNDEIINFYMNMLMERSKEKGLPSVHAFNTFFFTKLKTAGYQAVKRWTKKVDVFSVDILLVPIHLGVHWCLAVVDFRKKNITYYDSMGGINNEACRILLQYLKQESIDKKRKEFDTNGWQLFSKKSQEIPQQMNGSDCGMFACKYADCITKDRPINFTQQHMPYFRKRMVWEILHRKLL

SEQ ID NO: 851074 - protein, 445 aa, Homo sapiens
MVTGKQFTIAKPTTHFPLHLSRCLSSSKNTLKDSLFKNGNSCASQIIGSDTSSSGSASILTNQEQLSHSVYSLSSYTPDVAFGSKDSGTLHHPHHHHSVPHQPDNLAASNTQSEGSDSVILLKVKDSQTPTPSSTFFQAELWIKELTSVYDSRARERLRQIEEQKALALQLQNQRLQEREHSVHDSVELHLRVPLEKEIPVTVVQETQKKGHKLTDSEDEFPEITEEMEKEIKNVFRNGNQDEVLSEAFRLTITRKDIQTLNHLNWLNDEIINFYMNMLMERSKEKGLPSVHAFNTFFFTKLKTAGYQAVKRWTKKVDVFSVDILLVPIHLGVHWCLAVVDFRKKNITYYDSMGGINNEACRILLQYLKQESIDKKRKEFDTNGWQLFSKKSQEIPQQMNGSDCGMFACKYADCITKDRPINFTQQHMPYFRKRMVWEILHRKLL

SEQ ID NO: 851075 - protein, 117 aa, Homo sapiens; identical to SEQ ID NO: 851071

SEQ ID NO: 851076 - protein, 194 aa, Homo sapiens
MDDIADRMRMDAGEVTLVNHNSVFKTHLLPQTGFPEDQLSLSDQQILSSRQGHLDRSFTCSTRSAAYNPSYYSDNPSSDSFLGSGDLRTFGQSANGQWRNSTPSSSSSLQKSRNSRSLYLETRKTSSGLSNSFAGKSNHHCHVSAYEKSFPIKPVPSPSWSGSCRRSLLSPKKTQRRHVSTAEEEYEVFYKINN

SEQ ID NO: 851077 - protein, 482 aa, Homo sapiens [sequence omitted]

SEQ ID NO: 851078 - protein, 644 aa, Homo sapiens
MDDIADRMRMDAGEVTLVNHNSVFKTHLLPQTGFPEDQLSLSDQQILSSRQGHLDRSFTCSTRSAAYNPSYYSDNPSSDSFLGSGDLRTFGQSANGQWRNSTPSSSSSLQKSRNSRSLYLETRKTSSGLSNSFAGKSNHHCHVSAYEKSFPIKPVPSPSWSGSCRRSLLSPKKTQRRHVSTAEETVQEEEREIYRQLLQMVTGKQFTIAKPTTHFPLHLSRCLSSSKNTLKDSLFKNGNSCASQIIGSDTSSSGSASILTNQEQLSHSVYSLSSYTPDVAFGSKDSGTLHHPHHHHSVPHQPDNLAASNTQSEGSDSVILLKVKDSQTPTPSSTFFQAELWIKELTSVYDSRARERLRQIEEQKALALQLQNQRLQEREHSVHDSVELHLRVPLEKEIPVTVVQETQKKGHKLTDSEDEFPEITEEMEKEIKNVFRNGNQDEVLSEAFRLTITRKDIQTLNHLNWLNDEIINFYMNMLMERSKEKGLPSVHAFNTFFFTKLKTAGYQAVKRWTKKVDVFSVDILLVPIHLGVHWCLAVVDFRKKNITYYDSMGGINNEACRILLQYLKQESIDKKRKEFDTNGWQLFSKKSQEIPQQMNGSDCGMFACKYADCITKDRPINFTQQHMPYFRKRMVWEILHRKLL

SEQ ID NO: 851079 - protein, 445 aa, Homo sapiens; identical to SEQ ID NO: 851074

SEQ ID NO: 851080 - protein, 612 aa, Homo sapiens
PSGNDSLKFPPLHILSSRQGHLDRSFTCSTRSAAYNPSYYSDNPSSDSFLGSGDLRTFGQSANGQWRNSTPSSSSSLQKSRNSRSLYLETRKTSSGLSNSFAGKSNHHCHVSAYEKSFPIKPVPSPSWSGSCRRSLLSPKKTQRRHVSTAEETVQEEEREIYRQLLQMVTGKQFTIAKPTTHFPLHLSRCLSSSKNTLKDSLFKNGNSCASQIIGSDTSSSGSASILTNQEQLSHSVYSLSSYTPDVAFGSKDSGTLHHPHHHHSVPHQPDNLAASNTQSEGSDSVILLKVKDSQTPTPSSTFFQAELWIKELTSVYDSRARERLRQIEEQKALALQLQNQRLQEREHSVHDSVELHLRVPLEKEIPVTVVQETQKKGHKLTDSEDEFPEITEEMEKEIKNVFRNGNQDEVLSEAFRLTITRKDIQTLNHLNWLNDEIINFYMNMLMERSKEKGLPSVHAFNTFFFTKLKTAGYQAVKRWTKKVDVFSVDILLVPIHLGVHWCLAVVDFRKKNITYYDSMGGINNEACRILLQYLKQESIDKKRKEFDTNGWQLFSKKSQEIPQQMNGSDCGMFACKYADCITKDRPINFTQQHMPYFRKRMVWEILHRKLL

SEQ ID NO: 851081 - protein, 162 aa, Homo sapiens
PSGNDSLKFPPLHILSSRQGHLDRSFTCSTRSAAYNPSYYSDNPSSDSFLGSGDLRTFGQSANGQWRNSTPSSSSSLQKSRNSRSLYLETRKTSSGLSNSFAGKSNHHCHVSAYEKSFPIKPVPSPSWSGSCRRSLLSPKKTQRRHVSTAEEEYEVFYKINN

SEQ ID NO: 851082 - protein, 494 aa, Homo sapiens
MITVNPPLPQDTVNLFSPVPPPDKVDGFSRRSLRRARPRRSHSSSQFRYQSNQQELTPLPLLKDVPASELHELLSRKLAQCGVMFDFLDCVADLKGKEVKRAALNELVECVGSTRGVLIEPVYPDIIRMISVNIFRTLPPSENPEFDPEEDEPNLEPSWPHLQLVYEFFLRFLESPDFQPSVAKRYVDQKFVLMLLELFDSEDPREREYLKTILHRVYGKFLGLRAYIRKQCNHIFLRFIYEFEHFNGVAELLEILGSIINGFALPLKTEHKQFLVRVLIPLHSVKSLSVFHAQLAYCVVQFLEKDATLTEHVIRGLLKYWPKTCTQKEVMFLGEMEEILDVIEPSQFVKIQEPLFKQVARCVSSPHFQVAERALYFWNNEYILSLIEDNCHTVLPAVFGTLYQVSKEHWNQTIVSLIYNVLKTFMEMNGKLFDELTASYKLEKQQEQQKAQERQELWQGLEELRLRRLQGTQGAKEAPLQRLTPQVAASGGQS

SEQ ID NO: 851083 - protein, 497 aa, Homo sapiens
METKLPPASTPTSPSSPGLSPVPPPDKVDGFSRRSLRRARPRRSHSSSQFRYQSNQQELTPLPLLKDVPASELHELLSRKLAQCGVMFDFLDCVADLKGKEVKRAALNELVECVGSTRGVLIEPVYPDIIRMISVNIFRTLPPSENPEFDPEEDEPNLEPSWPHLQLVYEFFLRFLESPDFQPSVAKRYVDQKFVLMLLELFDSEDPREREYLKTILHRVYGKFLGLRAYIRKQCNHIFLRFIYEFEHFNGVAELLEILGSIINGFALPLKTEHKQFLVRVLIPLHSVKSLSVFHAQLAYCVVQFLEKDATLTEHVIRGLLKYWPKTCTQKEVMFLGEMEEILDVIEPSQFVKIQEPLFKQVARCVSSPHFQVAERALYFWNNEYILSLIEDNCHTVLPAVFGTLYQVSKEHWNQTIVSLIYNVLKTFMEMNGKLFDELTASYKLEKQQEQQKAQERQELWQGLEELRLRRLQGTQGAKEAPLQRLTPQVAASGGQS

SEQ ID NO: 851084 - protein, 497 aa, Homo sapiens; identical to SEQ ID NO: 851083

SEQ ID NO: 851085 - protein, 411 aa, Homo sapiens
MFDFLDCVADLKGKEVKRAALNELVECVGSTRGVLIEPVYPDIIRMISVNIFRTLPPSENPEFDPEEDEPNLEPSWPHLQLVYEFFLRFLESPDFQPSVAKRYVDQKFVLMLLELFDSEDPREREYLKTILHRVYGKFLGLRAYIRKQCNHIFLRFIYEFEHFNGVAELLEILGSIINGFALPLKTEHKQFLVRVLIPLHSVKSLSVFHAQLAYCVVQFLEKDATLTEHVIRGLLKYWPKTCTQKEVMFLGEMEEILDVIEPSQFVKIQEPLFKQVARCVSSPHFQVAERALYFWNNEYILSLIEDNCHTVLPAVFGTLYQVSKEHWNQTIVSLIYNVLKTFMEMNGKLFDELTASYKLEKQQEQQKAQERQELWQGLEELRLRRLQGTQGAKEAPLQRLTPQVAASGGQS

SEQ ID NO: 851086 - protein, 456 aa, Homo sapiens
METKLPPASTPTSPSSPGLSPVPPPDKVDGFSRRSLRRARPRRSHSSSQFRYQSNQQELTPLPLLKDVPASELHELLSRKLAQCGVMFDFLDCVADLKGKEVKRAALNELVECVGSTRGVLIEPVYPDIIRMISVNIFRTLPPSENPEFDPEEDEPNLEPSWPHLQLVYEFFLRFLESPDFQPSVAKRYVDQKFVLMLLELFDSEDPREREYLKTILHRVYGKFLGLRAYIRKQCNHIFLRFIYEFEHFNGVAELLEILGSIINGFALPLKTEHVIRGLLKYWPKTCTQKEVMFLGEMEEILDVIEPSQFVKIQEPLFKQVARCVSSPHFQVAERALYFWNNEYILSLIEDNCHTVLPAVFGTLYQVSKEHWNQTIVSLIYNVLKTFMEMNGKLFDELTASYKLEKQQEQQKAQERQELWQGLEELRLRRLQGTQGAKEAPLQRLTPQVAASGGQS

SEQ ID NO: 851087 - protein, 109 aa, Homo sapiens
MARSGGAAATPATGDPGGQGGPPPAAYTPGGRQWGSELDSTSEGEKLNPELSVPLSLLLSRGPERNTPTPGLARVASEDSLPSPAFTGGRRGEAMVVLATECSAPRGRT

SEQ ID NO: 851088 - protein, 497 aa, Homo sapiens; identical to SEQ ID NO: 851083

SEQ ID NO: 851089 - protein, 351 aa, Homo sapiens
METKLPPASTPTSPSSPGLSPVPPPDKVDGFSRRSLRRARPRRSHSSSQFRYQSNQQELTPLPLLKDVPASELHELLSRKLAQCGVMFDFLDCVADLKGKEVKRAALNELVECVGSTRGVLIEPVYPDIIRMISVNIFRTLPPSENPEFDPEEDEPNLEPSWPHLQLVYEFFLRFLESPDFQPSVAKRYVDQKFVLMLLELFDSEDPREREYLKTILHRVYGKFLGLRAYIRKQCNHIFLRFIYEFEHFNGVAELLEILGSIINGFALPLKTEHVIRGLLKYWPKTCTQKEVMFLGEMEEILDVIEPSQFVKIQEPLFKQVARCVSSPHFQHCGADSAFPARSTYAKPHLK

SEQ ID NO: 851090 - protein, 185 aa, Homo sapiens
METKLPPASTPTSPSSPGLSPVPPPDKVDGFSRRSLRRARPRRSHSSSQFRYQSNQQELTPLPLLKDVPASELHELLSRKLAQCGVMFDFLDCVADLKGKEVKRAALNELVECVGSTRGVLIEPVYPDIIRMVSTCHPGSEGRPRGRVSPVSCPQDPCVENNPVLIGLASVHDFLPPDLLLPNTH

SEQ ID NO: 851091 - protein, 497 aa, Homo sapiens; identical to SEQ ID NO: 851083

SEQ ID NO: 851092 - protein, 497 aa, Homo sapiens; identical to SEQ ID NO: 851083

SEQ ID NO: 851093 - protein, 479 aa, Homo sapiens
METKLPPASTPTSPSSPGLSPVPPPDKVDGFSRRSLRRARPRRSHSSSQFRYQSNQQELTPLPLLKDVPASELHELLSRKLAQCGVMFDFLDCVADLKGKEVKRAALNELVECVGSTRGVLIEPVYPDIIRMISVNIFRTLPPSENPEFDPEEDEPNLEPSWPHLQLVYEFFLRFLESPDFQPSVAKRYVDREYLKTILHRVYGKFLGLRAYIRKQCNHIFLRFIYEFEHFNGVAELLEILGSIINGFALPLKTEHKQFLVRVLIPLHSVKSLSVFHAQLAYCVVQFLEKDATLTEHVIRGLLKYWPKTCTQKEVMFLGEMEEILDVIEPSQFVKIQEPLFKQVARCVSSPHFQVAERALYFWNNEYILSLIEDNCHTVLPAVFGTLYQVSKEHWNQTIVSLIYNVLKTFMEMNGKLFDELTASYKLEKQQEQQKAQERQELWQGLEELRLRRLQGTQGAKEAPLQRLTPQVAASGGQS

SEQ ID NO: 851094 - protein, 164 aa, Homo sapiens
MNMPAAAGSLGGSDSPCPAQLSLGGDEERQWWSWQQNAQPLVAGLDKGKLDQEAAIRDLPLPRKARLQLQAGSHPLLLALGKGTQRLACPCLGQCEVLPYPHHGVHGLFILAQLTLYTDTVLGAHSSLPSLCTSLSPFYLLGRGRGRAQARRDSQCPGVRGGSQ

SEQ ID NO: 851095 - protein, 247 aa, Homo sapiens
METKLPPASTPTSPSSPGLSPVPPPDKVDGFSRRSLRRARPRRSHSSSQFRYQSNQQELTPLPLLKDVPASELHELLSRKLAQCGVMFDFLDCVADLKGKEVKRAALNELVECVGSTRGVLIEPVYPDIIRMISVNIFRTLPPSENPEFDPEEAGSHPLLLALGKGTQRLACPCLGQCEVLPYPHHGVHGLFILAQLTLYTDTVLGAHSSLPSLCTSLSPFYLLGRGRGRAQARRDSQCPGVRGGSQ

SEQ ID NO: 851096 - protein, 107 aa, Homo sapiens
VETGFHHVGQAGLKLLSSGDPPASASQSAGITGISHYAQPGLGIWMGDNAVREDGKVKQQKRVNGFSWMEENSSSSPLCLESKSQLGNAVIQLHFKETNSTMERLGN

SEQ ID NO: 851097 - protein, 258 aa, Homo sapiens
APGAATVRRCLLLPPPRDLLCPQLGGEEAGAEPRGAPSPSPRGGKSAASRVRWTPRPPRPSPGCPQAPARPGPAPGSERAAAQVSAYEVCKIDCLIQNRKTVITVLLSSQTLPKMEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKCSSSL

SEQ ID NO: 851098 - protein, 1039 aa, Homo sapiens
MSPLFSWVAKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 851099 - protein, 1282 aa, Homo sapiens
APGAATVRRCLLLPPPRDLLCPQLGGEEAGAEPRGAPSPSPRGGKSAASRVRWTPRPPRPSPGCPQAPARPGPAPGSERAAAQVSAYEVCKIDCLIQNRKTVITVLLSSQTLPKMEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 851100 - protein, 847 aa, Homo sapiens
FYRCHSLGPCLDPQNLNPVGRAGWLSYYQTHSSENEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 851101 - protein, 1376 aa, Homo sapiens
APGAATVRRCLLLPPPRDLLCPQLGGEEAGAEPRGAPSPSPRGGKSAASRVRWTPRPPRPSPGCPQAPARPGPAPGSERAAAQVSAYEVCKIDCLIQNRKTVITVLLSSQTLPKMEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKCGSSPVGESKHRPGQSSAPAPPPRLNPSASSPNFFKYLKHNSSGEQSGNAVPKSISYRNALRKKLHSSSSVPNFLKFLAPVDENNTSDFMNTKRDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 851102 - protein, 1282 aa, Homo sapiens; identical to SEQ ID NO: 851099

SEQ ID NO: 851103 - protein, 1282 aa, Homo sapiens; identical to SEQ ID NO: 851099

SEQ ID NO: 851104 - protein, 1282 aa, Homo sapiens; identical to SEQ ID NO: 851099

SEQ ID NO: 851105 - protein, 1282 aa, Homo sapiens; identical to SEQ ID NO: 851099

SEQ ID NO: 851106 - protein, 1104 aa, Homo sapiens
APGAATVRRCLLLPPPRDLLCPQLGGEEAGAEPRGAPSPSPRGGKSAASRVRWTPRPPRPSPGCPQAPARPGPAPGSERAAAQVSAYEVCKIDCLIQNRKTVITVLLSSQTLPKMEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFGEH

SEQ ID NO: 851107 - protein, 1058 aa, Homo sapiens
APGAATVRRCLLLPPPRDLLCPQLGGEEAGAEPRGAPSPSPRGGKSAASRVRWTPRPPRPSPGCPQAPARPGPAPGSERAAAQVSAYEVCKIDCLIQNRKTVITVLLSSQTLPKMEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIPTTRGTSRT

SEQ ID NO: 851108 - protein, 131 aa, Homo sapiens
MRFLLTLVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 851109 - protein, 892 aa, Homo sapiens
APGAATVRRCLLLPPPRDLLCPQLGGEEAGAEPRGAPSPSPRGGKSAASRVRWTPRPPRPSPGCPQAPARPGPAPGSERAAAQVSAYEVCKIDCLIQNRKTVITVLLSSQTLPKMEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKCGSSPVGESKHRPGQSSAPAPPPRLNPSASSPNFFKYLKHNSSGEQSGNAVPKSISYRNALRKKLHSSSSVPNFLKFLAPVDENNTSDFMNTKRDFESKANHLGDSGGTPVKTRRHSWRQQIFLRVATPQKACDSSSRYEV

SEQ ID NO: 851110 - protein, 649 aa, Homo sapiens
APGAATVRRCLLLPPPRDLLCPQLGGEEAGAEPRGAPSPSPRGGKSAASRVRWTPRPPRPSPGCPQAPARPGPAPGSERAAAQVSAYEVCKIDCLIQNRKTVITVLLSSQTLPKMEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESLLPQLSELTRCPFLVLWWGAKGPIF

SEQ ID NO: 851111 - protein, 490 aa, Homo sapiens
APGAATVRRCLLLPPPRDLLCPQLGGEEAGAEPRGAPSPSPRGGKSAASRVRWTPRPPRPSPGCPQAPARPGPAPGSERAAAQVSAYEVCKIDCLIQNRKTVITVLLSSQTLPKMEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVREDKQFLPWNLLYKEF

SEQ ID NO: 851112 - protein, 1282 aa, Homo sapiens; identical to SEQ ID NO: 851099

SEQ ID NO: 851113 - protein, 1042 aa, Homo sapiens
MAELKKFLDPVFEVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 851114 - protein, 1295 aa, Homo sapiens
APGAATVRRCLLLPPPRDLLCPQLGGEEAGAEPRGAPSPSPRGGKSAASRVRWTPRPPRPSPGCPQAPARPGPAPGSERAAAQVSAYEVCKIDCLIQNRKTVITVLLSSQTLPKMEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEEPHCGSPSLACTEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 851115 - protein, 1282 aa, Homo sapiens; identical to SEQ ID NO: 851099

SEQ ID NO: 851116 - protein, 700 aa, Homo sapiens
MKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 851117 - protein, 647 aa, Homo sapiens
ARPAPTRLGRAGVNSAEGKPAVEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 851118 - protein, 1282 aa, Homo sapiens; identical to SEQ ID NO: 851099

SEQ ID NO: 851119 - protein, 180 aa, Homo sapiens
MIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 851120 - protein, 908 aa, Homo sapiens
APGAATVRRCLLLPPPRDLLCPQLGGEEAGAEPRGAPSPSPRGGKSAASRVRWTPRPPRPSPGCPQAPARPGPAPGSERAAAQVSAYEVCKIDCLIQNRKTVITVLLSSQTLPKMEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEVLLREETGLPASRFLRTPTCNSGGMSQCFFCCF

SEQ ID NO: 851121 - protein, 758 aa, Homo sapiens
APGAATVRRCLLLPPPRDLLCPQLGGEEAGAEPRGAPSPSPRGGKSAASRVRWTPRPPRPSPGCPQAPARPGPAPGSERAAAQVSAYEVCKIDCLIQNRKTVITVLLSSQTLPKMEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKCGSFTCG

SEQ ID NO: 851122 - protein, 619 aa, Homo sapiens [sequence omitted]

SEQ ID NO: 851123 - protein, 619 aa, Homo sapiens [sequence omitted]

SEQ ID NO: 851124 - protein, 619 aa, Homo sapiens [sequence omitted]

SEQ ID NO: 851125 - protein, 143 aa, Homo sapiens
MTVLKENVMLQSQKAGSPPSIVLGPAQVQQVLTSNVQTICNGTVSVASSPSFSATAPVVTFSPRSSQLVAHPPGTVITSVIKTQETKTLTQEVEKKESEDHLKENTEKTEQQPQPYVMVVSSSNGFTSQVAMKQNELLEPNSF

SEQ ID NO: 851126 - protein, 419 aa, Homo sapiens
MAAVVQQNDLVFEFASNVMEDERQLGDPAIFPAVIVEHVPGADILNSYAGLACVEEPSDMITESSLDVAEEEIIDDDDDDITLTVEASCHDGDETIETIEAAEALLNMDSPGPMLDEKRINNNIFSSPEDDMVVAPVTHVSVTLDGIPEVMETQQVQEKYADSPGASSPEQPKRKKGRKTKPPRPDSPATTPNISVKKKNKDGKGNTIYLWEFLLALLQDKATCPKYIKWTQREKGIFKLVDSKAVSRLWGKHKNKPDMNYETMGRALRYYYQRGILAKVEGQRLVYQFKEMPKDLIYINDEDPSSSIESSDPSLSSSATSNRNQTSRSRVSSSPGVKGGATTVLKPGNSKAAKPKDPVEVAQPSEVLRTVQPTQSPYPTQLFRTVHVVQPVQAVPEGEAARTSTMQDETLNSSVQSIR

SEQ ID NO: 851127 - protein, 658 aa, Homo sapiens
MAAVVQQNDLVFEFASNVMEDERQLGDPAIFPAVIVEHVPGADILNSYAGLACVEEPSDMITESSLDVAEEEIIDDDDDDITLTVETGFLHVGQSQTPDLKQSACLGFPKCGITGMSHCASQVFEASCHDGDETIETIEAAEALLNMDSPGPMLDEKRINNNIFSSPEDDMVVAPVTHVSVTLDGIPEVMETQQVQEKYADSPGASSPEQPKRKKGRKTKPPRPDSPATTPNISVKKKNKDGKGNTIYLWEFLLALLQDKATCPKYIKWTQREKGIFKLVDSKAVSRLWGKHKNKPDMNYETMGRALRYYYQRGILAKVEGQRLVYQFKEMPKDLIYINDEDPSSSIESSDPSLSSSATSNRNQTSRSRVSSSPGVKGGATTVLKPGNSKAAKPKDPVEVAQPSEVLRTVQPTQSPYPTQLFRTVHVVQPVQAVPEGEAARTSTMQDETLNSSVQSIRTIQAPTQVPVVVSPRNQQLHTVTLQTVPLTTVIASTDPSAGTGSQKFILQAIPSSQPMTVLKENVMLQSQKAGSPPSIVLGPAQVQQVLTSNVQTICNGTVSVASSPSFSATAPVVTFSPRSSQLVAHPPGTVITSVIKTQETKTLTQEVEKKESEDHLKENTEKTEQQPQPYVMVVSSSNGFTSQVAMKQNELLEPNSF

SEQ ID NO: 851128 - protein, 619 aa, Homo sapiens [sequence omitted]

SEQ ID NO: 851129 - protein, 595 aa, Homo sapiens
MAAVVQQNDLVFEFASNVMEDERQLGDPAIFPAVIVEHVPGADILNSYAGLACVEEPSDMITESSLDVAEEEIIDDDDDDITLTVEASCHDGDETIETIEAAEALLNMDSPGPMLDEKRINGIPEVMETQQVQEKYADSPGASSPEQPKRKKGRKTKPPRPDSPATTPNISVKKKNKDGKGNTIYLWEFLLALLQDKATCPKYIKWTQREKGIFKLVDSKAVSRLWGKHKNKPDMNYETMGRALRYYYQRGILAKVEGQRLVYQFKEMPKDLIYINDEDPSSSIESSDPSLSSSATSNRNQTSRSRVSSSPGVKGGATTVLKPGNSKAAKPKDPVEVAQPSEVLRTVQPTQSPYPTQLFRTVHVVQPVQAVPEGEAARTSTMQDETLNSSVQSIRTIQAPTQVPVVVSPRNQQLHTVTLQTVPLTTVIASTDPSAGTGSQKFILQAIPSSQPMTVLKENVMLQSQKAGSPPSIVLGPAQVQQVLTSNVQTICNGTVSVASSPSFSATAPVVTFSPRSSQLVAHPPGTVITSVIKTQETKTLTQEVEKKESEDHLKENTEKTEQQPQPYVMVVSSSNGFTSQVAMKQNELLEPNSF

SEQ ID NO: 851130 - protein, 619 aa, Homo sapiens
MAAVVQQNDLVFEFASNVMEDERQLGDPAIFPAVIVEHVPGADILNSYAGLACVEEPSDMITESSLDVAEEEIIDDDDDDITLTVEASCHDGDETIETIEAAEALLNMDSPGPMLDEKRINNNIFSSPEDDMVVAPVTHVSVTLDGIPEVMETQQVQEKYADSPGASSPEQPKRKKGRKTKPPRPDSPATTPNISVKKKNKDGKGNTIYLWEFLLALLQDKATCPKYIKWTQREKGIFKLVDSKAVSRLWGKHKNKPDMNYETMGRALRYYYQRGILAKVEGQRLVYQFKEMPKDLIYINDEDPSSSIESSDPSLSSSATSNRNQTSRSRVSSSPGVKGGATTVLKPGNSKAAKPKDPVEVAQPSEVLRTVQPTQSPYPTQLFRTVHVVQPVQAVPEGEAARTSTMQDETLNSSVQSIRTIQAPTQVPVVVSPRNQQLHTVTLQTVPLTTVIASTDPSAGTGSQKFILQAIPSSQPMTVLKENVMLQSQKAGSPPSIVLGPAQVQQVLTSNVQTICNGTVSVASSPSFSATAPVVTFSPRSSQLVAHPPGTVITSVIKTQETKTLTQEVEKKESEDHLKENTEKTEQQPQPYVMVVSSSNGFTSQFWSLGSPISMHQQV

SEQ ID NO: 851131 - protein, 531 aa, Homo sapiens
MAPTIQTQAQREDGHRPNSHRTLPERSGVVCRVKYCNSLPDIPFDPKFITYPFDQNRFVQYKATSLEKQHKHDLLTEPDLGVTIDLINPDTYRIDPNVLLDPADEKLLEEEIQAPTSSKRSQQHAKVVPWMRKTEYISTEFNRYGISNEKPEVKIGVSVKQQFTEEEIYKDRDSQITAIEKTFEDAQKSISQHYSKPRVTPVEVMPVFPDFKMWINPCAQVIFDSDPAPKDTSGAAALEMMSQAMIRGMMDEEGNQFVAYFLPVEETLKKRKRDQEEEMDYAPDDVYDYKIAREYNWNVKNKASKGYEENYFFIFREGDGVYYNELETRVRLSKRRAKAGVQSGTNALLVVKHRDMNEKELEAQEARKAQLENHEPEEEEEEEMETEEKEAGGSDEEQEKGSSSEKEGSEDEHSGSESEREEGDRDEASDKSGSGEDESSEDEARAARDKEEIFGSDADSEDDADSDDEDRGQAQGGSDNDSDSGSNGGGQRSRSHSRSASPFPSGSEHSAQEDGSEAAASDSSEADSDSD

SEQ ID NO: 851132 - protein, 531 aa, Homo sapiens; identical to SEQ ID NO: 851131

SEQ ID NO: 851133 - protein, 557 aa, Homo sapiens [sequence omitted]

SEQ ID NO: 851134 - protein, 705 aa, Homo sapiens
MAPTIQTQAQREDGHRPNSHRTLPERSGVVCRVKYCNSLPDIPFDPKFITYPFDQNRFVQYKATSLEKQHKHDLLTEPDLGVTIDLINPDTYRIDPNVLLDPADEKLLEEEIQAPTSSKRSQQHAKVVPWMRKTEYISTEFNRYGISNEKPEVKIGVSVKQQFTEEEIYKDRDSQITAIEKTFEDAQKSISQHYSKPRVTPVEVMPVFPDFKMWINPCAQVIFDSDPAPKDTSGAAALEMMSQAMIRGMMDEEGNQFVAYFLPVEETLKKRKRDQEEEMDYAPDDVYDYKIAREYNWNVKNKASKGYEENYFFIFREGDGVYYNELETRVRLSKRRAKAGVQSGTNALLVVKHRDMNEKELEAQEAPDRPSLENHATGRHGHEATQDHARPTQHKHSRRAPQNSRSQAQPRHAPPLTQGRHADTTEPTSEAQRKSSNGRTEQAEPGAPTGPAEQNQVGPPAPTPTDEAHRTRLDRPSAPAQVAPHPKRPPPSRAPQMASHFPARERIRPKSTHRTGGHTHRTRAPTGSGTPNHSNIHEDRATDAHGQVGHTAGKARRTHQPPASRPTVPTSPARRTHHAAHSSAPRQPNRPAPDQPRKNPIRNTKPETSEHDRKAPPVEATAKGPSPGGLEVEQKTTIHRRTPKATGTSLHKPRNRDRRKPHTHTCPRTPGTTAQPLAQAPTHRPPPALLTRTRAPSNPNTSAQT

SEQ ID NO: 851135 - protein, 502 aa, Homo sapiens
LEPESRVYPPGDLRCFPRDTLSGPFDQEFVQYKATSLEKQHKHDLLTEPDLGVTIDLINPDTYRIDPNVLLDPADEKLLEEEIQAPTSSKRSQQHAKVVPWMRKTEYISTEFNRYGISNEKPEVKIGVSVKQQFTEEEIYKDRDSQITAIEKTFEDAQKSISQHYSKPRVTPVEVMPVFPDFKMWINPCAQVIFDSDPAPKDTSGAAALEMMSQAMIRGMMDEEGNQFVAYFLPVEETLKKRKRDQEEEMDYAPDDVYDYKIAREYNWNVKNKASKGYEENYFFIFREGDGVYYNELETRVRLSKRRAKAGVQSGTNALLVVKHRDMNEKELEAQEARKAQLENHEPEEEEEEEMETEEKEAGGSDEEQEKGSSSEKEGSEDEHSGSESEREEGDRDEASDKSGSGEDESSEDEARAARDKEEIFGSDADSEDDADSDDEDRGQAQGGSDNDSDSGSNGGGQRSRSHSRSASPFPSGSEHSAQEDGSEAAASDSSEADSDSD

SEQ ID NO: 851136 - protein, 466 aa, Homo sapiens
VLEDTRSYDRGRPWGYQSTLSQILTPTASTPIVLLDPADEKLLEEEIQAPTSSKRSQQHAKVVPWMRKTEYISTEFNRYGISNEKPEVKIGVSVKQQFTEEEIYKDRDSQITAIEKTFEDAQKSISQHYSKPRVTPVEVMPVFPDFKMWINPCAQVIFDSDPAPKDTSGAAALEMMSQAMIRGMMDEEGNQFVAYFLPVEETLKKRKRDQEEEMDYAPDDVYDYKIAREYNWNVKNKASKGYEENYFFIFREGDGVYYNELETRVRLSKRRAKAGVQSGTNALLVVKHRDMNEKELEAQEARKAQLENHEPEEEEEEEMETEEKEAGGSDEEQEKGSSSEKEGSEDEHSGSESEREEGDRDEASDKSGSGEDESSEDEARAARDKEEIFGSDADSEDDADSDDEDRGQAQGGSDNDSDSGSNGGGQRSRSHSRSASPFPSGSEHSAQEDGSEAAASDSSEADSDSD

SEQ ID NO: 851137 - protein, 97 aa, Homo sapiens
MEQAVSKSLPTGEPAFRLCHGGHFILSSSPEKLRLWEAGLCGVKLESKHHNRCFPTQVFVQYKATSLEKQHKHDLLTEPDLGVTIDLINPDTYRIDP

SEQ ID NO: 851138 - protein, 161 aa, Homo sapiens
VLEDTRSYDRGRPWGYQSTLSQILTPTASTPIVLLDPADEKLLEEEIQAPTSSKRSQQHAKVVPWMRKTEYISTEFNRYGISNEKPEVKIGVSVKQQFTEEEIYKDRDSQITAIEKTFEDAQKSISQHYSKPRVTPVEVMPVFPDFKMWINPCAQELSRTD

SEQ ID NO: 851139 - protein, 531 aa, Homo sapiens; identical to SEQ ID NO: 851131

SEQ ID NO: 851140 - protein, 558 aa, Homo sapiens
MAPTIQTQAQREDGHRPNSHRTLPERSGVVCRVKYCNSLPDIPFDPKFITYPFDQNRFVQYKATSLEKQHKHDLLTEPDLGVTIDLINPDTYRIDPNVLLDPADEKLLEEEIQAPTSSKRSQQHAKVVPWMRKTEYISTEFNRYGISNEKPEVKIGVSVKQQFTEEEIYKDRDSQITAIEKTFEDAQKSISQHYSKPRVTPVEVMPVFPDFKVRPKVGGRKGQPICACSHLTPVPPSPKMWINPCAQVIFDSDPAPKDTSGAAALEMMSQAMIRGMMDEEGNQFVAYFLPVEETLKKRKRDQEEEMDYAPDDVYDYKIAREYNWNVKNKASKGYEENYFFIFREGDGVYYNELETRVRLSKRRAKAGVQSGTNALLVVKHRDMNEKELEAQEARKAQLENHEPEEEEEEEMETEEKEAGGSDEEQEKGSSSEKEGSEDEHSGSESEREEGDRDEASDKSGSGEDESSEDEARAARDKEEIFGSDADSEDDADSDDEDRGQAQGGSDNDSDSGSNGGGQRSRSHSRSASPFPSGSEHSAQEDGSEAAASDSSEADSDSD

SEQ ID NO: 851141 - protein, 478 aa, Homo sapiens
MATGPIPTGLCLRGLEWSAESSTAIASLISPSTPSSSPTPSTRTVLLDPADEKLLEEEIQAPTSSKRSQQHAKVVPWMRKTEYISTEFNRYGISNEKPEVKIGVSVKQQFTEEEIYKDRDSQITAIEKTFEDAQKSISQHYSKPRVTPVEVMPVFPDFKMWINPCAQVIFDSDPAPKDTSGAAALEMMSQAMIRGMMDEEGNQFVAYFLPVEETLKKRKRDQEEEMDYAPDDVYDYKIAREYNWNVKNKASKGYEENYFFIFREGDGVYYNELETRVRLSKRRAKAGVQSGTNALLVVKHRDMNEKELEAQEARKAQLENHEPEEEEEEEMETEEKEAGGSDEEQEKGSSSEKEGSEDEHSGSESEREEGDRDEASDKSGSGEDESSEDEARAARDKEEIFGSDADSEDDADSDDEDRGQAQGGSDNDSDSGSNGGGQRSRSHSRSASPFPSGSEHSAQEDGSEAAASDSSEADSDSD

SEQ ID NO: 851142 - protein, 306 aa, Homo sapiens
SHYEEVLTQLRHVLERQNNEYQVLLGIYTHLEKEITTYRRLLEGESEGTREEEMDYAPDDVYDYKIAREYNWNVKNKASKGYEENYFFIFREGDGVYYNELETRVRLSKRRAKAGVQSGTNALLVVKHRDMNEKELEAQEARKAQLENHEPEEEEEEEMETEEKEAGGSDEEQEKGSSSEKEGSEDEHSGSESEREEGDRDEASDKSGSGEDESSEDEARAARDKEEIFGSDADSEDDADSDDEDRGQAQGGSDNDSDSGSNGGGQRSRSHSRSASPFPSGSEHSAQEDGSEAAASDSSEADSDSD

SEQ ID NO: 851143 - protein, 1003 aa, Homo sapiens
MANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRAPSDATSSRHPPDASFPAALNFLQRTRPSSVLSEDLLMQRAVAKHPALLPLADVFLSFKAWLRVDEDEDDLEEEHITKIYYCSRTHSQLAQFVHEVKKSPFGKDVRLVSLGSRQNLCVNEDVKSLGSVQLINDRCVDMQRSRHEKKKGAEEEKPKRRRQEKQAACPFYNHEQMGLLRDEALAEVKDMEQLLALGKEARACPYYGSRLAIPAAQLVVLPYQMLLHAATRQAAGIRLQDQVVIIDEAHNLIDTITGMHSVEVSGSQLCQAHSQLLQYVERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASTLRPASPLMHIEGFLAALTTANQDGRVILSRQGSLSQSTLKFLLLNPAVHFAQVVKECRAVVIAGGTMQPVSDFRQQLLACAGVEAERVVEFSCVFGPSLALPGHVIPPDNILPLVICSGISNQPLEFTFQKRELPQMMDEVGRILCNLCGVVPGGVVCFFPSYEYLRQVHAHWEKGGLLGRLAARKKIFQEPKSAHQVEQVLLAYSRCIQACGQERGQVTGALLLSVVGGKMSEGINFSDNLGRCVVMVGMPFPNIRSAELQEKMAYLDQTLPRAPGQAPPGKALVENLCMKAVNQSIGRAIRHQKDFASIVLLDQRYARPPVLAKLPAWIRARVEVKATFGPAIAAVQKVSPTFFFLRASPPRDHISHCLLSAQFHREKSASS

SEQ ID NO: 851144 - protein, 167 aa, Homo sapiens
MGLLRDEALAEVKDMEQLLALGKEARACPYYGSRLAIPAAQLVVLPYQMLLHAATRQAAGIRLQDQVVIIDEAHNLIDTITGMHSVEVSGSQLCQAHSQLLQYVERYGKRLKAKNLMYLKQILYLLEKFVAVLGGESLVPLLTPGLQNSLGCFFLGCPSGHLSSLCF

SEQ ID NO: 851145 - protein, 906 aa, Homo sapiens
MANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRVDEDEDDLEEEHITKIYYCSRTHSQLAQFVHEVKKSPFGKDVRLVSLGSRQNLCVNEDVKSLGSVQLINDRCVDMQRSRHEKKKGAEEEKPKRRRQEKQAACPFYNHEQMGLLRDEALAEVKDMEQLLALGKEARACPYYGSRLAIPAAQLVVLPYQMLLHAATRQAAGIRLQDQVVIIDEAHNLIDTITGMHSVEVSGSQLCQAHSQLLQYVERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASTLRPASPLMHIEGFLAALTTANQDGRVILSRQGSLSQSTLKFLLLNPAVHFAQVVKECRAVVIAGGTMQPVSDFRQQLLACAGVEAERVVEFSCGHVIPPDNILPLVICSGISNQPLEFTFQKRELPQMMDEVGRILCNLCGVVPGGVVCFFPSYEYLRQVHAHWEKGGLLGRLAARKKIFQEPKSAHQVEQVLLAYSRCIQACGQERGQVTGALLLSVVGGKMSEGINFSDNLGRCVVMVGMPFPNIRSAELQEKMAYLDQTLPRAPGQAPPGKALVENLCMKAVNQSIGRAIRHQKDFASIVLLDQRYARPPVLAKLPAWIRARVEVKATFGPAIAAVQKFHREKSASS

SEQ ID NO: 851146 - protein, 509 aa, Homo sapiens
MGLLRDEALAEVKDMEQLLALGKEARACPYYGSRLAIPAAQLVVLPYQMLLHAATRQAAGIRLQDQVVIIDEAHNLIDTITGMHSVEVSGSQLCQAHSQLLQYVERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASTLRPASPLMHIEGFLAALTTANQDGRVILSRQGSLSQSTLKFLLLNPAVHFAQVVKECRAVVIAGGTMQPVSDFRQQLLACAGVEAERVVEFSCGHVIPPDNILPLVICSGISNQPLEFTFQKRELPQMMDEVGRILCNLCGVVPGGVVCFFPSYEYLRQVHAHWEKGGLLGRLAARKKIFQEPKSAHQVEQVLLAYSRCIQACGQERGQVTGALLLSVVGGKMSEGINFSDNLGRCVVMVGMPFPNIRSAELQEKMAYLDQTLAGPSGTRRILPA

SEQ ID NO: 851147 - protein, 509 aa, Homo sapiens; identical to SEQ ID NO: 851146

SEQ ID NO: 851148 - protein, 906 aa, Homo sapiens; identical to SEQ ID NO: 851145

SEQ ID NO: 851149 - protein, 917 aa, Homo sapiens
MANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRVDEDEDDLEEEHITKIYYCSRTHSQLAQFVHEVKKSPFGKDVRLVSLGSRQNLCVNEDVKSLGSVQLINDRCVDMQRSRHEKKKGAEEEKPKRRRQEKQAACPFYNHEQMGLLRDEALAEVKDMEQLLALGKEARACPYYGSRLAIPAAQLVVLPYQMLLHAATRQAAGIRLQDQVVIIDEAHNLIDTITGMHSVEVSGSQLCQAHSQLLQYVERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASTLRPASPLMHIEGFLAALTTANQDGRVILSRQGSLSQSTLKFLLLNPAVHFAQVVKECRAVVIAGGTMQPVSDFRQQLLACAGVEAERVVEFSCGHVIPPDNILPLVICSGISNQPLEFTFQKRELPQMMDEVGRILCNLCGVVPGGVVCFFPSYEYLRQVHAHWEKGGLLGRLAARKKIFQEPKSAHQVEQVLLAYSRCIQACGQERGQVTGALLLSVVGGKMSEGINFSDNLGRQGHQAPEGFCQHSAPGPAICPAPCPGQAAGLDPSPCGGQSYLWPRHCCCAEVSPGEVGLFLMGNHTTAWRRALPLSCPLETVFVVGVVCGDPVTKVKPRRRVWSPECCQDPGTGVSSRRRKWGNPE

SEQ ID NO: 851150 - protein, 1023 aa, Homo sapiens
MANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRVDEDEDDLEEEHITKIYYCSRTHSQLAQFVHEVKKSPFGKDVRLVSLGSRQNLCVNEDVKSLGSVQLINDRCVDMQRSRHEKKKGAEEEKPKRRRQEKQAACPFYNHEQMGLLRDEALAEVKDMEQLLALGKEARACPYYGSRLAIPAAQLVVLPYQMLLHAATRQAAGIRLQDQVVIIDEAHNLIDTITGMHSVEVSGSQLCQAHSQLLQYVERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASTLRPASPLMHIEGFLAALTTANQDGRVILSRQGSLSQSTLKFLLLNPAVHFAQVVKECRAVVIAGGTMQPVSDFRQQLLACAGVEAERVVEFSCGEKLCPGWGRLEVRFWPPFSVGNTSYCDQAQGRRRPRGGSLTLRALAQALLLCSLLPAAQCDWRWWAGERCQSLFLCWMMGQGNALSAVSCSTPASPFSAPPWLLPGHVIPPDNILPLVICSGISNQPLEFTFQKRELPQMMDEVGRILCNLCGVVPGGVVCFFPSYEYLRQVHAHWEKGGLLGRLAARKKIFQEPKSAHQVEQVLLAYSRCIQACGQERGQVTGALLLSVVGGKMSEGINFSDNLGRQGHQAPEGFCQHSAPGPAICPAPCPGQAAGLDPSPCGGQSYLWPRHCCCAEVSPGEVGLFLMGNHTTAWRRALPLSCPLETVFVVGVVCGDPVTKVKPRRRVWSPECCQDPGTGVSSRRRKWGNPE

SEQ ID NO: 851151 - protein, 542 aa, Homo sapiens
MANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRVDEDEDDLEEEHITKIYYCSRTHSQLAQFVHEVKECRAVVIAGGTMQPVSDFRQQLLACAGVEAERVVEFSCGHVIPPDNILPLVICSGISNQPLEFTFQKRELPQMMDEVGRILCNLCGVVPGGVVCFFPSYEYLRQVHAHWEKGGLLGRLAARKKIFQEPKSAHQVEQVLLAYSRCIQACGQERGQVTGALLLSVVGGKMSEGINFSDNLGRCVVMVGMPFPNIRSAELQEKMAYLDQTLPRAPGQAPPGKALVENLCMKAVNQSIGRAIRHQKDFASIVLLDQRYARPPVLAKLPAWIRARVEVKATFGPAIAAVQKFHREKSASS

SEQ ID NO: 851152 - protein, 392 aa, Homo sapiens
MANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKVRPGVSGSSGISNQPLEFTFQKRELPQMMDEVGRILCNLCGVVPGGVVCFFPSYEYLRQVHAHWEKGGLLGRLAARKKIFQEPKSAHQVEQVLLAYSRCIQACGQERGQVTGALLLSVVGGKMSEGINFSDNLGRQGHQAPEGFCQHSAPGPAICPAPCPGQAAGLDPSPCGGQSYLWPRHCCCAEVSPGEVGLFLMGNHTTAWRRALPLSCPLETVFVVGVVCGDPVTKVKPRRRVWSPECCQDPGTGVSSRRRKWGNPE

SEQ ID NO: 851153 - protein, 489 aa, Homo sapiens
MANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRVDEDEDDLEEEHITKIYYCSRTHSQLAQFVHEVKKSPFGKDVRLVSLGSRQNLCVNEDVKSLGSVQLINDRCVDMQRSRHEKKKGAEEEKPKRRRQEKQAACPFYNHEQMGLLRDEALAEVKDMEQLLALGKEARACPYYGSRLAIPAAQLVVLPYQMLLHAATRQAAGIRLQDQVVIIDEAHNLIDTITGMHSVEVSGSQLCQAHSQLLQYVERYGKRLKAKNLMYLKQILYLLEKFVAVLGGESLVPLLTPGLQNSLGCFFLGCPSGHLSSLCF

SEQ ID NO: 851154 - protein, 906 aa, Homo sapiens; identical to SEQ ID NO: 851145

SEQ ID NO: 851155 - protein, 856 aa, Homo sapiens
MANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRVDEDEDDLEEEHITKIYYCSRTHSQLAQFVHEVKKSPFGKDVRLVSLGSRQNLCVNEDVKSLGSVQLINDRCVDMQRSRHEKKKGAEEEKPKRRRQEKQAACPFYNHEQMGLLRDEALAEVKDMEQLLALGKEARACPYYGSRLAIPAAQLVVLPYQMLLHAATRQAAGIRLQDQVVIIDEAHNLIDTITGMHSVEVSGSQLCQAHSQLLQYVERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASTLRPASPLMHIEGFLAALTTANQDGRVILSRQGSLSQSTLKFLLLNPAVHFAQVVKECRAVVIAGGTMQPVSDFRQQLLACAGVEAERVVEFSCGHVIPPDNILPLVICSGISNQPLEFTFQKRELPQMIFQEPKSAHQVEQVLLAYSRCIQACGQERGQVTGALLLSVVGGKMSEGINFSDNLGRCVVMVGMPFPNIRSAELQEKMAYLDQTLPRAPGQAPPGKALVENLCMKAVNQSIGRAIRHQKDFASIVLLDQRYARPPVLAKLPAWIRARVEVKATFGPAIAAVQKFHREKSASS

SEQ ID NO: 851156 - protein, 76 aa, Homo sapiens
VGGPENQHCDLFPFSFLGNIKQNPNTQSLSQTGTELKTINDFLFQSQIDNINLFKVQRYCEKSMISRKVTAPILWS

SEQ ID NO: 851157 - protein, 906 aa, Homo sapiens; identical to SEQ ID NO: 851145

SEQ ID NO: 851158 - protein, 509 aa, Homo sapiens; identical to SEQ ID NO: 851146

SEQ ID NO: 851159 - protein, 584 aa, Homo sapiens [sequence omitted]

SEQ ID NO: 851160 - protein, 426 aa, Homo sapiens
RPLYPTITNINLFKVQRYCEKSMISRKLFGFTERYGAVFSSREQPKLAGFQQFLQSLQPRTTEALAAPADESQASTLRPASPLMHIEGFLAALTTANQDGRVILSRQGSLSQSTLKFLLLNPAVHFAQVVKECRAVVIAGGTMQPVSDFRQQLLACAGVEAERVVEFSCGHVIPPDNILPLVICSGISNQPLEFTFQKRELPQMMDEVGRILCNLCGVVPGGVVCFFPSYEYLRQVHAHWEKGGLLGRLAARKKIFQEPKSAHQVEQVLLAYSRCIQACGQERGQVTGALLLSVVGGKMSEGINFSDNLGRCVVMVGMPFPNIRSAELQEKMAYLDQTLPRAPGQAPPGKALVENLCMKAVNQSIGRAIRHQKDFASIVLLDQRYARPPVLAKLPAWIRARVEVKATFGPAIAAVQKFHREKSASS

SEQ ID NO: 851161 - protein, 516 aa, Homo sapiens
MAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRVDEDEDDLEEEHITKIYYCSRTHSQLAQFVHEVKECRAVVIAGGTMQPVSDFRQQLLACAGVEAERVVEFSCGHVIPPDNILPLVICSGISNQPLEFTFQKRELPQMMDEVGRILCNLCGVVPGGVVCFFPSYEYLRQVHAHWEKGGLLGRLAARKKIFQEPKSAHQVEQVLLAYSRCIQACGQERGQVTGALLLSVVGGKMSEGINFSDNLGRCVVMVGMPFPNIRSAELQEKMAYLDQTLPRAPGQAPPGKALVENLCMKAVNQSIGRAIRHQKDFASIVLLDQRYARPPVLAKLPAWIRARVEVKATFGPAIAAVQKFHREKSASS

SEQ ID NO: 851162 - protein, 775 aa, Homo sapiens
MANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRVDEDEDDLEEEHITKIYYCSRTHSQLAQFVHEVKKSPFGKDVRLVSLGSRQNLCVNEDVKSLGSVQLINDRCVDMQRSRHEKKKGAEEEKPKRRRQEKQAACPFYNHEQMGLLRDEALAEVKDMEQLLALGKEARACPYYGSRLAIPAAQLVVLPYQMLLHAATRQAAGIRLQDQVVIIDEAHNLIDTITGMHSVEVSGSQLCQAHSQLLQYVERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASTLRPASPLMHIEGFLAALTTANQDGRVILSRQGSLSQSTLKFLLLNPAVHFAQVVKECRAVVIAGGTMQPVSDFRQQLLACAGVEAERVVEFSCGHVIPPDNILPLVICSGISNQPLEFTFQKRELPQMMDEVGRILCNLCGVVPGGVVCFFPSYEYLRQVHAHWEKGGLLGRLAARKKVSGLSAAFPLVRTVPLSPPGSSRAHRVRTGFWLLIPTAPSP

SEQ ID NO: 851163 - protein, 247 aa, Homo sapiens
METVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREGVAQGMVTSRTL

SEQ ID NO: 851164 - protein, 81 aa, Homo sapiens
MAVPTSIYQTSTGQYTATGDMPTYQIRAPTAALPQGVVMAASPGSLHSPQQLAEEATRKRELRLMKNREGVAQGMVTSRTL

SEQ ID NO: 851165 - protein, 281 aa, Homo sapiens [sequence omitted]

SEQ ID NO: 851166 - protein, 218 aa, Homo sapiens [sequence omitted]

SEQ ID NO: 851167 - protein, 269 aa, Homo sapiens
MWWHQHNLCFRRPIEEDYSSGDVEEKVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 851168 - protein, 219 aa, Homo sapiens [sequence omitted]

SEQ ID NO: 851169 - protein, 120 aa, Homo sapiens
MAVTGDDTDEETELAPSHMAAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 851170 - protein, 112 aa, Homo sapiens
MNRTQELSGQLSAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 851171 - protein, 244 aa, Homo sapiens
MVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 851172 - protein, 348 aa, Homo sapiens
MSKCARKKYIKTNPRQMTMETVESQHDGSITASLTESKSAHVQTQTGQNSIPALAQCSELRSGTRRGSPAVTLVQLPSGQTIHVQGVIQTPQPWVIQSSEIHTVQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 851173 - protein, 67 aa, Homo sapiens
LVRSELWDAEPGAVEQQQAPHARFVRSAAPGPACLLANLGRVGKSSLREPCGSGERFNSEKEKESRR

SEQ ID NO: 851174 - protein, 198 aa, Homo sapiens
ISFFFPPTFLRRRRPLVAVAAIAETDESAESEGVIDSHKRREILSRRPSYRKILNELSSDVPGVPKIEEERSEEEGTPPSIATMAVPTSIYQTSTGQYTATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 851175 - protein, 219 aa, Homo sapiens [sequence omitted]

SEQ ID NO: 851176 - protein, 138 aa, Homo sapiens
MTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 851177 - protein, 113 aa, Homo sapiens
MNRTQELSGQLSAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 851178 - protein, 135 aa, Homo sapiens [sequence omitted]

SEQ ID NO: 851179 - protein, 109 aa, Homo sapiens
MAVTGDDTAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 851180 - protein, 348 aa, Homo sapiens; identical to SEQ ID NO: 851172

SEQ ID NO: 851181 - protein, 87 aa, Homo sapiens
RPRPLTRTFPPPLPGSISLLDCGASLLLAAGRGRSSSLDFFPRGLPREAVPAWGRGGRGGRTRFGRLQRYFWSGVGREAAATASQLT

SEQ ID NO: 851182 - protein, 87 aa, Homo sapiens; identical to SEQ ID NO: 851181

SEQ ID NO: 851183 - protein, 348 aa, Homo sapiens; identical to SEQ ID NO: 851172

SEQ ID NO: 851184 - protein, 108 aa, Homo sapiens
MAVTGDDTAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 851185 - protein, 348 aa, Homo sapiens; identical to SEQ ID NO: 851172

SEQ ID NO: 851186 - protein, 282 aa, Homo sapiens
METVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 851187 - protein, 349 aa, Homo sapiens
MSKCARKKYIKTNPRQMTMETVESQHDGSITASLTESKSAHVQTQTGQNSIPALAQCSELRSGTRRGSPAVTLVQLPSGQTIHVQGVIQTPQPWVIQSSEIHTVQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 851188 - protein, 87 aa, Homo sapiens; identical to SEQ ID NO: 851181

SEQ ID NO: 851189 - protein, 218 aa, Homo sapiens [sequence omitted]

SEQ ID NO: 851190 - protein, 245 aa, Homo sapiens
MVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 851191 - protein, 102 aa, Homo sapiens
MAAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 851192 - protein, 120 aa, Homo sapiens
TVTPHFTDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 851193 - protein, 87 aa, Homo sapiens; identical to SEQ ID NO: 851181

SEQ ID NO: 851194 - protein, 135 aa, Homo sapiens [sequence omitted]

SEQ ID NO: 851195 - protein, 195 aa, Homo sapiens
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGNWARAIFSKTKFGTQKNTFFPRGKAFLVSQTPKGAVPF

SEQ ID NO: 851196 - protein, 215 aa, Homo sapiens
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 851197 - protein, 200 aa, Homo sapiens
DAWVDPRVGVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 851198 - protein, 209 aa, Homo sapiens
RPTLEETQFGPGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 851199 - protein, 260 aa, Homo sapiens
DAWVDPRVGRGRVRGLRCSGRRRSLEVATSLPHPSPGPRPAADVKMSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 851200 - protein, 215 aa, Homo sapiens; identical to SEQ ID NO: 851196

SEQ ID NO: 851201 - protein, 215 aa, Homo sapiens; identical to SEQ ID NO: 851196

SEQ ID NO: 851202 - protein, 215 aa, Homo sapiens; identical to SEQ ID NO: 851196

SEQ ID NO: 851203 - protein, 215 aa, Homo sapiens; identical to SEQ ID NO: 851196

SEQ ID NO: 851204 - protein, 215 aa, Homo sapiens; identical to SEQ ID NO: 851196

SEQ ID NO: 851205 - protein, 215 aa, Homo sapiens; identical to SEQ ID NO: 851196

SEQ ID NO: 851206 - protein, 215 aa, Homo sapiens; identical to SEQ ID NO: 851196

SEQ ID NO: 851207 - protein, 110 aa, Homo sapiens [sequence omitted]

SEQ ID NO: 851208 - protein, 209 aa, Homo sapiens; identical to SEQ ID NO: 851198

SEQ ID NO: 851209 - protein, 263 aa, Homo sapiens
LRQYEAGVNRPRRGRVRGLRCSGRRRSLEVATSLPHPSPGPRPAADVKMSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 851210 - protein, 132 aa, Homo sapiens
NALRLPQRGPRSKPIFWSQESTLWVRKGPQEAEGNLWNAEKPCNEITSRLPLTITLTRVRRSHLEPKGKWRSAKGRAEWLAPPQVSALGRSSSHTAHPTPPKSLRTEPSRTSPLMRQEPGGNSMPVKGLWRD

SEQ ID NO: 851211 - protein, 215 aa, Homo sapiens; identical to SEQ ID NO: 851196

SEQ ID NO: 851212 - protein, 215 aa, Homo sapiens; identical to SEQ ID NO: 851196

SEQ ID NO: 851213 - protein, 225 aa, Homo sapiens
MAGTTSADVKMSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 851214 - protein, 215 aa, Homo sapiens; identical to SEQ ID NO: 851196

SEQ ID NO: 851215 - protein, 164 aa, Homo sapiens
MILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 851216 - protein, 110 aa, Homo sapiens [sequence omitted]

SEQ ID NO: 851217 - protein, 125 aa, Homo sapiens [sequence omitted]

SEQ ID NO: 851218 - protein, 1862 aa, Homo sapiens
MQSFRERCGFHGKQQNYQQTSQETSRLENYRQPSQAGLSCDRQRLLAKDYYNPQPYPSYEGGAGTPSGTAAAVAADKYHRGSKALPTQQGLQGRPAFPGYGVQDSSPYPGRYAGEESLQAWGAPQPPPPQPQPLPAGVAKYDENLMKKTAVPPSRQYAEQGAQVPFRTHSLHVQQPPPPQQPLAYPKLQRQKLQNDIASPLPFPQGWWAGGHSYKSCTAPTAQPHDRPLTASSSLAPGQRVQNLHAYQSGRLSYDQQQQQQQQQQQQQQALQSRHHAQETLHYQNLAKYQHYGQQGQGYCQPDAAVRTPEQYYQTFSPSSSHSPARSVGRSPSYSSTPSPLMPNLENFPYSQQPLSTGAFPAGITDHSHFMPLLNPSPTDATSSPADLTALTSQVENISNTVQQLLLSKAAVPQKKGVKNLVSRTPEQHKSQHCSPEGSGYSAEPAGTPLSEPPSSTPQSTHAEPQEADYLSGSEDPLERSFLYCNQARGSPARVNSNSKAKPESVSTCSVTSPDDMSTKSDDSFQSLHGSLPLDSFSKFVAGERDCPRLLLSALAQEDLASEILGLQEAIGEKADKAWAEAPSLVKDSSKPPFSLENHSACLDSVAKSAWPRPGEPEALPDSLQLDKGGNAKDFSPGLFEDPSVAFATPDPKKTTGPLSFGTKPTLGVPAPDPTTAAFDCFPDTTAASSADSANPFAWPEENLGDACPRWGLHPGELTKGLEQGGKASDGISKGDTHEASACLGFQEEDPPGEKVASLPGDFKQEEVGGVKEEAGGLLQCPEVAKADRWLEDSRHCCSTADFGDLPLLPPTSRKEDLEAEEEYSSLCELLGSPEQRPGMQDPLSPKAPLICTKEEVEEVLDSKAGWGSPCHLSGESVILLGPTVGTESKVQSWFESSLSHMKPGEEGPDGERAPGDSTTSDASLAQKPNKPAVPEAPIAKKEPVPRGKSLRSRRVHRGLPEAEDSPCRAPVLPKDLLLPESCTGPPQGQMEGAGAPGRGASEGLPRMCTRSLTALSEPRTPGPPGLTTTPAPPDKLGGKQRAAFKSGKRVGKPSPKAASSPSNPAALPVASDSSPMGSKTKETDSPSTPGKDQRSMILRSRTKTQEIFHSKRRRPSEGRLPNCRATKKLLDNSHLPATFKVSSSPQKEGRVSQRARVPKPGAGSKLSDRPLHALKRKSAFMAPVPTKKRNLVLRSRSSSSSNASGNGGDGKEERPEGSPTLFKRMSSPKKAKPTKGNGEPATKLPPPETPDACLKLASRAAFQGAMKTKVLPPRKGRGLKLEAIVQKITSPSLKKFACKAPGASPGNPLSPSLSDKDRGLKGAGGSPVGVEEGLVNVGTGQKLPTSGADPLCRNPTNRSLKGKLMNRASGTQGASEDNSGGGGKKPKMEELGLASQPPEGRPCQPQTRAQKQPGHTNYSSYSKRKRLTRGRAKNTTSSPCKGRAKRRRQQQVLPLDPAEPEIRLKYISSCKRLRSDSRTPAFSPFVRVEKRDAFTTICTVVNSPGDAPKPHRKPSSSASSSSSSSSFSLDAAGASLATLPGGSILQPRPSLPLSSTMHLGPVVSKALSTSCLVCCLCQNPANFKDLGDLCGPYYPEHCLPKKKPKLKEKVRPEGTCEEASLPLERTLKGPECAAAATAGKPPRPDGPADPAKQGPLRTSARGLSRRLQSCYCCDGREDGGEEAAPADKGHWVHEACAVWTGGVYLVAGKLFGLQEAMKVAVDMHGGTVALAPGDFSLPGLRFASLFQGPSWCDCPVLATSTPSSWSRCVPAAKKPGPPLGAATKDASTPTTTRVPAMQVRARPGTGGHWSPSKQSRGTLPGHSSPNPGPISLFSFPPLLPQQFFYPSVCLDLCWAMPGTWK

SEQ ID NO: 851219 - protein, 1862 aa, Homo sapiens; identical to SEQ ID NO: 851218

SEQ ID NO: 851220 - protein, 1906 aa, Homo sapiens
MQSFRERCGFHGKQQNYQQTSQETSRLENYRQPSQAGLSCDRQRLLAKDYYNPQPYPSYEGGAGTPSGTAAAVAADKYHRGSKALPTQQGLQGRPAFPGYGVQDSSPYPGRYAGEESLQAWGAPQPPPPQPQPLPAGVAKYDENLMKKTAVPPSRQYAEQGAQVPFRTHSLHVQQPPPPQQPLAYPKLQRQKLQNDIASPLPFPQGTHFPQHSQSFPTSSTYSSSVQGGGQGAHSYKSCTAPTAQPHDRPLTASSSLAPGQRVQNLHAYQSGRLSYDQQQQQQQQQQQQQQALQSRHHAQETLHYQNLAKYQHYGQQGQGYCQPDAAVRTPEQYYQTFSPSSSHSPARSVGRSPSYSSTPSPLMPNLENFPYSQQPLSTGAFPAGITDHSHFMPLLNPSPTDATSSVDTQAGNCKPLQKDKLPENLLSDLSLQSLTALTSQVENISNTVQQLLLSKAAVPQKKGVKNLVSRTPEQHKSQHCSPEGSGYSAEPAGTPLSEPPSSTPQSTHAEPQEADYLSGSEDPLERSFLYCNQARGSPARVNSNSKAKPESVSTCSVTSPDDMSTKSDDSFQSLHGSLPLDSFSKFVAGERDCPRLLLSALAQEDLASEILGLQEAIGEKADKAWAEAPSLVKDSSKPPFSLENHSACLDSVAKSAWPRPGEPEALPDSLQLDKGGNAKDFSPGLFEDPSVAFATPDPKKTTGPLSFGTKPTLGVPAPDPTTAAFDCFPDTTAASSADSANPFAWPEENLGDACPRWGLHPGELTKGLEQGGKASDGISKGDTHEASACLGFQEEDPPGEKVASLPGDFKQEEVGGVKEEAGGLLQCPEVAKADRWLEDSRHCCSTADFGDLPLLPPTSRKEDLEAEEEYSSLCELLGSPEQRPGMQDPLSPKAPLICTKEEVEEVLDSKAGWGSPCHLSGESVILLGPTVGTESKVQSWFESSLSHMKPGEEGPDGERAPGDSTTSDASLAQKPNKPAVPEAPIAKKEPVPRGKSLRSRRVHRGLPEAEDSPCRAPVLPKDLLLPESCTGPPQGQMEGAGAPGRGASEGLPRMCTRSLTALSEPRTPGPPGLTTTPAPPDKLGGKQRAAFKSGKRVGKPSPKAASSPSNPAALPVASDSSPMGSKTKETDSPSTPGKDQRSMILRSRTKTQEIFHSKRRRPSEGRLPNCRATKKLLDNSHLPATFKVSSSPQKEGRVSQRARVPKPGAGSKLSDRPLHALKRKSAFMAPVPTKKRNLVLRSRSSSSSNASGNGGDGKEERPEGSPTLFKRMSSPKKAKPTKGNGEPATKLPPPETPDACLKLASRAAFQGAMKTKVLPPRKGRGLKLEAIVQKITSPSLKKFACKAPGASPGNPLSPSLSDKDRGLKGAGGSPVGVEEGLVNVGTGQKLPTSGADPLCRNPTNRSLKGKLMNSKKLSSTDCFKTEAFTSPEALQPGGTALAPKKRSRKGRAGAHGLSKGPLEKRPYLGPALLLTPRDRASGTQGASEDNSGGGGKKPKMEELGLASQPPEGRPCQPQTRAQKQPGHTNYSSYSKRKRLTRGRAKNTTSSPCKGRAKRRRQQQVLPLDPAEPEIRLKYISSCKRLRSDSRTPAFSPFVRVEKRDAFTTICTVVNSPGDAPKPHRKPSSSASSSSSSSSFSLDAAGASLATLPGGSILQPRPSLPLSSTMHLGPVVSKALSTSCLVCCLCQNPANFKDLGDLCGPYYPEHCLPKKKPKLKEKVRPEGTCEEASLPLERTLKGPECAAAATAGKPPRPDGPADPAKQGPLRTSARGLSRRLQSCYCCDGREDGGEEAAPADKGRKHECSKEAPAEPGGEAQEHWVHEACAVWTGGVYLVAGKLFGLQEAMKVAVDMMCSSCQEAGATIGCCHKGCLHTYHYPCASDAGCIFIEENFSLKCPKHKRLP

SEQ ID NO: 851221 - protein, 1906 aa, Homo sapiens; identical to SEQ ID NO: 851220

SEQ ID NO: 851222 - protein, 131 aa, Homo sapiens
LLSFSPRASPARPSARPLFLCGGDRIPRGTRGHQAGPAGCAAKARSPRPPGAAPARGWAPRDEWESECSEGERRAEQAALPAALAPARGGGAAAHPPSCLAAGRPGRRAPTPMATQASGPRSRSARPKAPE

SEQ ID NO: 851223 - protein, 1656 aa, Homo sapiens
MQSFRERCGFHGKQQNYQQTSQETSRLENYRQPSQAGLSCDRQRLLAKDYYNPQPYPSYEGGAGTPSGTAAAVAADKYHRGSKALPTQQGLQGRPAFPGYGVQDSSPYPGRYAGEESLQAWGAPQPPPPQPQPLPAGVAKYDENLMKKTAVPPSRQYAEQGAQVPFRTHSLHVQQPPPPQQPLAYPKLQRQKLQNDIASPLPFPQGTHFPQHSQSFPTSSTYSSSVQGGGQGAHSYKSCTAPTAQPHDRPLTASSSLAPGQRVQNLHAYQSGRLSYDQQQQQQQQQQQQQQALQSRHHAQETLHYQNLAKYQHYGQQGQGYCQPDAAVRTPEQYYQTFSPSSSHSPARSVGRSPSYSSTPSPLMPNLENFPYSQQPLSTGAFPAGITDHSHFMPLLNPSPTDATSSVDTQAGNCKPLQKDKLPENLLSDLSLQSLTALTSQVENISNTVQQLLLSKAAVPQKKGVKNLVSRTPEQHKSQHCSPEGSGYSAEPAGTPLSEPPSSTPQSTHAEPQEADYLSGSEDPLERSFLYCNQARGSPARVNSNSKAKPESVSTCSVTSPDDMSTKSDDSFQSLHGSLPLDSFSKFVAGERDCPRLLLSALAQEDLASEILGLQEAIGEKADKAWAEAPSLVKDSSKPPFSLENHSACLDSVAKSAWPRPGEPEALPDSLQLDKGGNAKDFSPGLFEDPSVAFATPDPKKTTGPLSFGTKPTLGVPAPDPTTAAFDCFPDTTAASSADSANPFAWPEENLGDACPRWGLHPGELTKGLEQGGKASDGISKGDTHEASACLGFQEEDPPGEKVASLPGDFKQEEVGGVKEEAGGLLQCPEVAKADRWLEDSRHCCSTADFGDLPLLPPTSRKEDLEAEEEYSSLCELLGSPEQRPGMQDPLSPKAPLICTKEEVEEVLDSKAGWGSPCHLSGESVILLGPTVGTESKVQSWFESSLSHMKPGEEGPDGERAPGDSTTSDASLAQKPNKPAVPEAPIAKKEPVPRGKSLRSRRVHRGLPEAEDSPCRAPVLPKDLLLPESCTGPPQGQMEGAGAPGRGASEGLPRMCTRSLTALSEPRTPGPPGLTTTPAPPDKLGGKQRAAFKSGKRVGKPSPKAASSPSNPAALPVASDSSPMGSKTKETDSPSTPGKDQRSMILRSRTKTQEIFHSKRRRPSEGRLPNCRATKKLLDNSHLPATFKVSSSPQKEGRVSQRARVPKPGAGSKLSDRPLHALKRKSAFMAPVPTKKRNLVLRSRSSSSSNASGNGGDGKEERPEGSPTLFKRMSSPKKAKPTKGNGEPATKLPPPETPDACLKLASRAAFQGAMKTKVLPPRKGRGLKLEAIVQKITSPSLKKFACKAPGASPGNPLSPSLSDKDRGLKGAGGSPVGVEEGLVNVGTGQKLPTSGADPLCRNPTNRSLKGKLMNSKKLSSTDCFKTEAFTSPEALQPGGTALAPKKRSRKGRAGAHGLSKGPLEKRPYLGPALLLTPRDRASGTQGASEDNSGGGGKKPKMEELGLASQPPEGRPCQPQTRAQKQPGHTNYSSYSKRKRLTRGRAKNTTSSPCKGRAKRRRQQQVLPLDPAEPEIRLKYISSCKRLRSDSRTPAFSPPGAQPGSAKPKKRPERTSGSGGRATVVHHQGPPRLLCTGAGTALDFVYKTCVPLYIYVT

SEQ ID NO: 851224 - protein, 1862 aa, Homo sapiens; identical to SEQ ID NO: 851218

SEQ ID NO: 851225 - protein, 177 aa, Homo sapiens
MLSKGLRDPRVWAGLGHPLASVCPLSSPPPHPWSPAWERKTQEAARTHLRLRRTRDRCAPPGTAAPTLHGSRDSARFRVQNLCTPLYICYIECIYVGNMLASPVCRRRASCARNRAPTGPLPGKGLPRRHLSTQPPPARASPCQSVRLSVRVLSSVHASIGLTQPPAQGRPSNFLYI

SEQ ID NO: 851226 - protein, 1906 aa, Homo sapiens; identical to SEQ ID NO: 851220

SEQ ID NO: 851227 - protein, 410 aa, Homo sapiens
MAAEIHSRPQSSRPVLLSKIEGHQDAVTAALLIPKEDGVITASEDRTIRVWLKRDSGQYWPSIYHTMASPCSAMAYHHDSRRIFVGQDNGAVMEFHVSEDFNKMNFIKTYPAHQNRVSAIIFSLATEWVISTGHDKCVSWMCTRSGNMLGRHFFTSWASCLQYDFDTQYAFVGDYSGQITLLKLEQNTCSVITTLKGHEGSVACLWWDPIQRLLFSGASDNSIIMWDIGGRKGRTLLLQGHHDKVQSLCYLQLTRQLVSCSSDGGIAVWNMDVSREEAPQWLESDSCQKCEQPFFWNIKQMWDTKTLGLRQHHCRKCGQAVCGKCSSKRSSYPVMGFEFQVRVCDSCYDSIKDEDRTSLATFHEGKHNISHMSMDIARGLMVTCGTDRIVKIWDMTPVVGCSLATGFSPH

SEQ ID NO: 851228 - protein, 392 aa, Homo sapiens
MAAEIHSRPQSSRPVLLSKIEGHQDAVTAALLIPKEDGVITASEDRTIRVWLKRDSGQYWPSIYHTMASPCSAMAYHHDSRRIFVGQDNGAVMVGSFQKIYIIFSLATEWVISTGHDKCVSWMCTRSGNMLGRHFFTSWASCLQYDFDTQYAFVGDYSGQITLLKLEQNTCSVITTLKGHEGSVACLWWDPIQRLLFSGASDNSIIMWDIGGRKGRTLLLQGHHDKVQSLCYLQLTRQLVSCSSDGGIAVWNMDVSREEAPQWLESDSCQKCEQPFFWNIKQMWDTKTLGLRQHHCRKCGQAVCGKCSSKRSSYPVMGFEFQVRVCDSCYDSIKDEDRTSLATFHEGKHNISHMSMDIARGLMVTCGTDRIVKIWDMTPVVGCSLATGFSPH

SEQ ID NO: 851229 - protein, 410 aa, Homo sapiens; identical to SEQ ID NO: 851227

SEQ ID NO: 851230 - protein, 379 aa, Homo sapiens
QLMGCLPRRPQQSPREHGGRNPLQAAEQPPGAAEQDRGAPGRRHGRAAHPQGGRRDHGQRGQEFHVSEDFNKMNFIKTYPAHQNRVSAIIFSLATEWVISTGHDKCVSWMCTRSGNMLGRHFFTSWASCLQYDFDTQYAFVGDYSGQITLLKLEQNTCSVITTLKGHEGSVACLWWDPIQRLLFSGASDNSIIMWDIGGRKGRTLLLQGHHDKVQSLCYLQLTRQLVSCSSDGGIAVWNMDVSREEAPQWLESDSCQKCEQPFFWNIKQMWDTKTLGLRQHHCRKCGQAVCGKCSSKRSSYPVMGFEFQVRVCDSCYDSIKDEDRTSLATFHEGKHNISHMSMDIARGLMVTCGTDRIVKIWDMTPVVGCSLATGFSPH

SEQ ID NO: 851231 - protein, 294 aa, Homo sapiens
MAAEIHSRPQSSRPVLLSKIEGHQDAVTAALLIPKEDGVITASEDRTIRVWLKRDSGQYWPSIYHTMASPCSAMAYHHDSRRIFVGQDNGAVMEFHVSEDFNKMNFIKTYPAHQNRVSAIIFSLATEWVISTGHDKCVSWMCTRSGNMLGRHFFTSWASCLQYDFDTQYAFVGDYSGQITLLKLEQNTCSVITTLKGHEGSVACLWWDPIQRLLFSGASDNSIIMWDIGGRKGRTLLLQGHHDKVQSLCYLQLTRQLVSCSSDGGIAVWNMDVSREEAPQWLESDSCQKCEQPR

SEQ ID NO: 851232 - protein, 410 aa, Homo sapiens; identical to SEQ ID NO: 851227

SEQ ID NO: 851233 - protein, 123 aa, Homo sapiens
MARYEEVSVSGFEEFHRAVEQHNGKTIFAYFTGSKDAGGKSWCPDCVQAEPVVREGLKHISEGCVFIYCQVGEKPYWKDPNNDFRKNLKVTAVPTLLKYGTPQKLVESECLQANLVEMLFSED

SEQ ID NO: 851234 - protein, 123 aa, Homo sapiens; identical to SEQ ID NO: 851233

SEQ ID NO: 851235 - protein, 166 aa, Homo sapiens
MARYEEVSVSGFEEFHRAVEQHNGKTIFAYFTGSKDAGGKSWCPDCVQGEAGIRGLLSNGNGRKVEAYGQKGGLAEAESWFQTSAEQSELSPSLLLLNPTPPCQERSSFYHLTRMILESSSLKLLTPPVPLVSYRIRELVSKYMCFPLLRARWCRGKSGLGFGPYP

SEQ ID NO: 851236 - protein, 123 aa, Homo sapiens; identical to SEQ ID NO: 851233

SEQ ID NO: 851237 - protein, 87 aa, Homo sapiens
ALNYLRIQVLQGAEPVVREGLKHISEGCVFIYCQVGEKPYWKDPNNDFRKNLKVTAVPTLLKYGTPQKLVESECLQANLVEMLFSED

SEQ ID NO: 851238 - protein, 112 aa, Homo sapiens
MARYEEVSVSGFEEFHRAVEQHNGKTIFAYFTGSKDAGGKSWCPDCVQAEPVVREGLKHISEGCVFIYCQVGEKPYWKDPNNDFRKNLKVTAVPTLLKYGTVSIFKYAGPVI

SEQ ID NO: 851239 - protein, 123 aa, Homo sapiens; identical to SEQ ID NO: 851233

SEQ ID NO: 851240 - protein, 166 aa, Homo sapiens; identical to SEQ ID NO: 851235

SEQ ID NO: 851241 - protein, 147 aa, Homo sapiens
MARYEEVSVSGFEEFHRAVEQHNGKTIFAYFTGSKDAGGKSWCPDCVQGEAGIRGLLSNGNGRKVEAYGQKGGLAEAESWFQTSAEQSELSPSLLLLNPTPPCQERSSFYHLTRMILESSSLKLLTPPVPLVSYRIRELLNQSYERG

SEQ ID NO: 851242 - protein, 652 aa, Homo sapiens
MAMDEYLWMVILGFIIAFILAFSVGANDVANSFGTAVGSGVVTLRQACILASIFETTGSVLLGAKVGETIRKGIIDVNLYNETVETLMAGEVSAMVGSAVWQLIASFLRLPISGTHCIVGSTIGFSLVAIGTKGVQWMELVKIVASWFISPLLSGFMSGLLFVLIRIFILKKEDPVPNGLRALPVFYAATIAINVFSIMYTGAPVLGLVLPMWAIALISFGVALLFAFFVWLFVCPWMRRKITGKLQKEGALSRVSDESLSKVQEAESPVFKELPGAKANDDSTIPLTGAAGETLGTSEGTSAGSHPRAAYGRALSMTHGSVKSPISNGTFGFDGHTRSDGHVYHTVHKDSGLYKDLLHKIHIDRGPEEKPAQESNYRLLRRNNSYTCYTAAICGLPVHATFRAADSSAPEDSEKLVGDTVSYSKKRLRYDSYSSYCNAVAEAEIEAEEGGVEMKLASELADPDQPREDPAEEEKEEKDAPEVHLLFHFLQVLTACFGSFAHGGNDVSNAIGPLVALWLIYKQGGVTQEAATPVWLLFYGGVGICTGLWVWGRRVIQTMGKDLTPITPSSGFTIELASAFTVVIASNIGLPVSTTHCKVGSVVAVGWIRSRKAVDWRLFRNIFVAWFVTVPVAGLFSAAVMALLMYGILPYV

SEQ ID NO: 851243 - protein, 652 aa, Homo sapiens; identical to SEQ ID NO: 851242

SEQ ID NO: 851244 - protein, 496 aa, Homo sapiens [sequence omitted]

SEQ ID NO: 851245 - protein, 652 aa, Homo sapiens; identical to SEQ ID NO: 851242

SEQ ID NO: 851246 - protein, 652 aa, Homo sapiens; identical to SEQ ID NO: 851242

SEQ ID NO: 851247 - protein, 836 aa, Homo sapiens
MNQLLLTSLRTLSFLCFLFLRIRLDSRRLILLKRQSKQSYAAISALYLRVCDIYHSLERLKNTQSKFGVEVEEGRKRKVSAIKGLIVNFYEIGLRSESISLNIFSDKRSLKRIKVSVLPLTSFSIVVICSLHSPLSFKTFSELTKQTETGQAQWLTPVIPALWEAELGGSQGQEIETILANMVKPRLYYKIQKKKKISQAWWQAPVVPATREAGAGEFLEPGRPRLQWAEIAPLHSSLGDSETLSQKEKEKKKQRLNLVNTHFIFERLNVSLNINLCHFVINCNSVRMPLTTNPFRFLCGKAHKLCGLTPLDPVVEHCENGAFGKTLYYAVDSHCLIFFLYSSIFYEYGAVLSFNYYNICELLEVDDVSAVFQLKNPYISHSWCLRYEEQPYKEGLIVLKILSAEPALIVRVVVWVILELKEWLRAINGPVIFTIPEQLVKNGRKATIRLLTRNLCRCARSSLCSGTIEMNKVWSFLSGGSQLNREYYYVNDSSTVWQMLKYMCVAAITGELINRESLAGLSDSPLKSQHFGRPRRADHLRSGVRDQPGQHGKTSSLLKNTKKISKAWWRASVIPATGEAEAGESLEPGRWRLQLAEIMPLHSSLGDRVRLSQKQNPKYYTIFIVSHLTLFLVKRSLFSLISLPDVFFSDFCVFHKSILKICNSCSIFDQNVPQVSEAMFKKKHVNIIGVGLRNDYFWEDLSKIYGTEVLEYVRILLSLFIVVIPTLGYIYLIPTCVYFLNNICFGDLDKVNFFAFLKVAVKLTSCISNVEKIWHSDLNFVYGLLSSKIISSLKYGSLACIPSDKLGWVNFSPEKIHSFDPGCLAWKKKITYSLHD

SEQ ID NO: 851248 - protein, 715 aa, Homo sapiens
MVLLDGFVVCLYIEHTSLLCISWVARMNQLLLTSLRTLSFLCFLFLRIRLVFWKTNTTLKTVKTVIRCLSALYLRVCDIYHSLERLKNTQSKFGGGGGEGRKRKVSAIKGLIVNFYEIGLRSESISLNIFSDKRSLKRIKSISTSVNYFSIGSFVVYILLSSFKTFSELTKQTETGQAQWLTPVIPALWEAELGGSQGQEIETILANMVKPRLYYKIQKKKKISQAWWQAPVVPATREAGAGEFLEPGRPRLQWAEIAPLHSSLGDSETLSQKEKKKKKQRLNLVNTHFIFERLNVSLNINLCHFVINCNSVRMPLTTNPFRFLCGKAHKLCGLTPLDPVVEHCENGAFGKTLYYAVDSHCLIFFLYSSIFYEYGAVLSFNYYNICELLEVDDVSAVFQLKNPYISHSWCLRYEEQPYKEGLIVLKILSAEPALIVEGGCLGILELKEWLRAINGPVIFTIPEQLVKNGRKATIRLLTRNLCRCARSSLCSGTIEMNKVWSFLSGGSQLNREYYYVNDSSTVWQMLKYMCVAAITGELINRESLAGLSDSPLKSQHFGRPRRADHLRSGVRDQPGQHGKTSSLLKNTKKISKAWWRASVIPATGEAEAGESLEPGRWRLQLAEIMPLHSSLGDRVRLSQKQNPKYYTIFIVSHLTLFLVKRSLFSLISLPDVFFSDFCVFHKSILKICNSWSIFDQNVPQVSEACSRRSMSTLLE

SEQ ID NO: 851249 - protein, 875 aa, Homo sapiens
MIQPSLSVLCGLGCAFLWATSSFAAVSPPACAPATSPSPVVHLRSTQPGQSCFVLLHRLGLPCVLSSSGSFSSPHLFCFLPVLVSPCALGPVSSFSINRYYYDGFVVCLYIEHTSLLCISWVARMNQLLLTSLRTLSFLCFLFLRIRLDSRRLILLKRQSKQSYAAISALYLRVCDIYHSLERLKNTQSKFGVEVEEGRKRKVSAIKGLIVNFYEIGLRSESISLNIFSDKRSLKRIKVSVLPLTSFSIVVICSLHSPLSFKTFSELTKQTETGQAQWLTPVIPALWEAELGGSQGQEIETILANMVKPRLYYKIQKKKKISQAWWQAPVVPATREAGAGEFLEPGRPRLQWAEIAPLHSSLGDSETLSQKEKEKKKQRLNLVNTHFIFERLNVSLNINLCHFVINCNSVRMPLTTNPFRFLCGKAHKLCGLTPLDPVVEHCENGAFGKTLYYAVDSHCLIFFLYSSIFYEYGAVLSFNYYNICELLEVDDVSAVFQLKNPYISHSWCLRYEEQPYKEGLIVLKILSAEPALIVEGGCLGILELKEWLRAINGPVIFTIPEQLVKNGRKATIRLLTRNLCRCARSSLCSGTIEMNKVWSFLSGGSQLNREYYYVNDSSTVWQMLKYMCVAAITGELINRESLAGLSDSPLKSQHFGRPRRADHLRSGVRDQPGQHGKTSSLLKNTKKISKAWWRASVIPATGEAEAGESLEPGRWRLQLAEIMPLHSSLGDRVRLSQKQNPKYYTIFIVSHLTLFLVKRSLFSLISLPDVFFSDFCVFHKSILKICNSCSIFDQNVPQVSEAMFKKKHVNIIGVGLRNDYFWEDLSKIYGYRSFGVCENITKSFYSCNPNTGLYIFNTNLSIFPEKYLFWRLGQS

SEQ ID NO: 851250 - protein, 144 aa, Homo sapiens
AGETQRRPQCRPRAREWSRAPFPYRAATPARAARAASREPPARLPGSRGWGPGLVGAGGARGGGGLRPPRLLAHVDLAVACRAAPLRKLDGSGRDRALPASAGRLLLRCARLGWDSAGEGSCTLSHQAQCSRAAQRISFLVLRA

SEQ ID NO: 851251 - protein, 144 aa, Homo sapiens; identical to SEQ ID NO: 851250

SEQ ID NO: 851252 - protein, 652 aa, Homo sapiens; identical to SEQ ID NO: 851242

SEQ ID NO: 851253 - protein, 652 aa, Homo sapiens; identical to SEQ ID NO: 851242

SEQ ID NO: 851254 - protein, 144 aa, Homo sapiens; identical to SEQ ID NO: 851250

SEQ ID NO: 851255 - protein, 652 aa, Homo sapiens; identical to SEQ ID NO: 851242

SEQ ID NO: 851256 - protein, 652 aa, Homo sapiens; identical to SEQ ID NO: 851242

SEQ ID NO: 851257 - protein, 697 aa, Homo sapiens
MAMDEYLWMVILGFIIAFILAFSVGANDVANSFGTAVGSGVVTLRQACILASIFETTGSVLLGAKVGETIRKGIIDVNLYNETVETLMAGEVSAMVGRDDDTTDSCCIRVIWLGRRGLERNSTTFCFQQDISSCRKSPAAGGSAVWQLIASFLRLPISGTHCIVGSTIGFSLVAIGTKGVQWMELVKIVASWFISPLLSGFMSGLLFVLIRIFILKKEDPVPNGLRALPVFYAATIAINVFSIMYTGAPVLGLVLPMWAIALISFGVALLFAFFVWLFVCPWMRRKITGKLQKEGALSRVSDESLSKVQEAESPVFKELPGAKANDDSTIPLTGAAGETLGTSEGTSAGSHPRAAYGRALSMTHGSVKSPISNGTFGFDGHTRSDGHVYHTVHKDSGLYKDLLHKIHIDRGPEEKPAQESNYRLLRRNNSYTCYTAAICGLPVHATFRAADSSAPEDSEKLVGDTVSYSKKRLRYDSYSSYCNAVAEAEIEAEEGGVEMKLASELADPDQPREDPAEEEKEEKDAPEVHLLFHFLQVLTACFGSFAHGGNDVSNAIGPLVALWLIYKQGGVTQEAATPVWLLFYGGVGICTGLWVWGRRVIQTMGKDLTPITPSSGFTIELASAFTVVIASNIGLPVSTTHCKVGSVVAVGWIRSRKAVDWRLFRNIFVAWFVTVPVAGLFSAAVMALLMYGILPYV

SEQ ID NO: 851258 - protein, 875 aa, Homo sapiens; identical to SEQ ID NO: 851249

SEQ ID NO: 851259 - protein, 712 aa, Homo sapiens
MDLLSAFYIEHTSLLCISWVARMNQLLLTSLRTLSFLCFLFLRIRLDSRRLILLKRQSKQSYAAISALYLRVCDIYHSLERLKNTQSKFGVEVEEGRKRKVSAIKGLIVNFYEIGLRSESISLNIFSDKRSLKRIKVSVLPLTSFSIVVICSLHSPLSFKTFSELTKQTETGQAQWLTPVIPALWEAELGGSQGQEIETILANMVKPRLYYKYKKKKKLARRGGRHLWSQLLGRLGQENFLSPGGRGCSELRSRHCTPAWVTARLCLKKKKKKKKQRLNLVNTHFIFERLNVSLNINLCHFVIYTVIVSEMPLTTNPFRFLCGKAHKLCGLTPLDPVVVAFENGAFGKTLYYAVDSHCLIFFLYSSIFYEYGAVLSFNYYNICELLEVDDVSAVFQLKNPYISHSWCLRYEEQPYKEGLIVLKILSAEPALIVEGGCLGILELKEWLRAINGPVIFTIPEQLVKNGRKATIRLLTRNLCRCARSSLCSGTIEMNKVWSFLSGGSQLNREYYYVNDSSTVWQMLKYMCVAAITGELINRESLAGLSDSPLKSQHFGRPRRADHLRSGVRDQPGQHGKTSSLLKNTKKISKAWWRASVIPATGEAEAGESLEPGRWRLQLAEIMPLHSSLGDRVRLSQKQNPKYYTIFIVSHLTLFLVKRSLFSLISLPDVFFSDFCVFHKSILKICNSCSIFDQNVPQVSEACSRRSMSTLLE

SEQ ID NO: 851260 - protein, 875 aa, Homo sapiens; identical to SEQ ID NO: 851249

SEQ ID NO: 851261 - protein, 144 aa, Homo sapiens; identical to SEQ ID NO: 851250

SEQ ID NO: 851262 - protein, 144 aa, Homo sapiens; identical to SEQ ID NO: 851250

SEQ ID NO: 851263 - protein, 144 aa, Homo sapiens; identical to SEQ ID NO: 851250

SEQ ID NO: 851264 - protein, 699 aa, Homo sapiens
PKQAWAMAGAPPPASLPPCSLISDCCAGNQRDSVGVGPSEPGCYPCPGPNMNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSVLSGVLPTFSPSTLMVASLVFVTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAGLVPPGSPGPITRHGSYDSLASDHSGQEDEEWLSQVEIVTHTGPHRRLWMGPQFQFKTIHPSGQTTVISSSSSVLQSHGPSDTPQPLLDFDTDDLDLNSLRIQPVRSDPVSMPGSSRPVSDRRGVSTVIDAASGTFDRSVTLLEVCGSWPEGFGLRHMSSMEHTEEGLRERLADAMAESPSRDVVGSGTELQREGSIETLSNSSGSTSGSIPRNFDGYRSPLPTNESQPLSLFPTGFP

SEQ ID NO: 851265 - protein, 113 aa, Homo sapiens [sequence omitted]

SEQ ID NO: 851266 - protein, 108 aa, Homo sapiens
LTGGAAGFMNEAMATDSPRRPSRCTGGVVVRPQAVTWSLTLLPRLECSGAVSARCSLHLLLCLPDSSDSPALASQVAGITGERHQAWPNFVFLAKTGFCHLARLVLNS

SEQ ID NO: 851267 - protein, 654 aa, Homo sapiens
MVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAGLVPPGSPGPITRHGSYDSLASDHSGQEDEEWLSQVEIVTHTGPHRRLWMGPQFQFKTIHPSGQTTVISSSSSVLQSHGPSDTPQPLLDFDTDDLDLNSLRIQPVRSDPVSMPGSSRPVSDRRGVSTVIDAASGTFDRSVTLLEVCGSWPEGFGLRHMSSMEHTEEGLRERLADAMAESPSRDVVGSGTDTALDVAVKTFPPERHVAVKCFELQREGSIETLSNSSGSTSGSIPRNFDGYRSPLPTNESQPLSLFPTGFP

SEQ ID NO: 851268 - protein, 842 aa, Homo sapiens
MIGYSDGMQVWSIPISGEAQELFSVRHGPIRAARILPAPQFGAQKCDNFAEKRPLLGVCKSIGSSGTSPPYCCVDLYSLRTGEMVKSIQFKTPIYDLHCNKRILVVVLQEKIAAFDSCTFTKKFFVTSCYPCPGPNMNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAGLVPPGSPGPITRHGSYDSLASDHSGQEDEEWLSQVEIVTHTGPHRRLWMGPQFQFKTIHPSGQTTVISSSSSVLQSHGPSDTPQPLLDFDTDDLDLNSLRIQPVRSDPVSMPGSSRPVSDRRGVSTVIDAASGTFDRSVTLLEVCGSWPEGFGLRHMSSMEHTEEGLRERLADAMAESPSRDVVGSGTDTALDVAVKTFPPERHVAVKCFELQREGSIETLSNSSGSTSGSIPRNFDGYRSPLPTNESQPLSLFPTGFP

SEQ ID NO: 851269 - protein, 389 aa, Homo sapiens
AFAVFFSKTSSQIRHLKAPIICKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAGLVPPGSPGPITRHGSYDSLASDHSGQEDEEWLSQVEIVTHTGPHRRLWMGPQFQFKTIHPSGQTTVISSSSSVLQSHGPSDTPQPLLDFDTDDLDLNSLRIQPVRSDPVSMPGSSRPVSDRRGVSTVIDAASGTFDRSVTLLEVCGSWPEGFGLRHMSSMEHTEEGLRERLADAMAESPSRDVVGSGTELQREGSIETLSNSSGSTSGSIPRNFDGYRSPLPTNESQPLSLFPTGFP

SEQ ID NO: 851270 - protein, 123 aa, Homo sapiens
MATDLRCPPMRASPSASSRLASRRYQQPASDWPAPSPAGGGEKPRSGPTLQSLLFLHQPPSPSLVTAAAHPTWMEKRPFSKHLSALALCHTCRWRLWPGETVEARSLCMFAYDILHWIRFCIF

SEQ ID NO: 851271 - protein, 123 aa, Homo sapiens; identical to SEQ ID NO: 851270

SEQ ID NO: 851272 - protein, 123 aa, Homo sapiens; identical to SEQ ID NO: 851270

SEQ ID NO: 851273 - protein, 123 aa, Homo sapiens; identical to SEQ ID NO: 851270

SEQ ID NO: 851274 - protein, 140 aa, Homo sapiens
PHDSIISTWSLPGHMGIMGTTSQDEIWVETQPNDISTFDRSVTLLEVCGSWPEGFGLRHMSSMEHTEEGLRERLADAMAESPSRDVVGSGTELQREGSIETLSNSSGSTSGSIPRNFDGYRSPLPTNESQPLSLFPTGFP

SEQ ID NO: 851275 - protein, 684 aa, Homo sapiens
MNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAGLVPPGSPGPITRHGSYDSLASDHSGQEDEEWLSQVEIVTHTGPHRRLWMGPQFQFKTIHPSGQTTVISSSSSVLQSHGPSDTPQPLLDFDTDDLDLNSLRIQPVRSDPVSMPGSSRPVSDRRGVSTVIDAASGTFDRSVTLLEVCGSWPEGFGLRHMSSMEHTEEGLRERLADAMAESPSRDVVGSGTELQREGSIETLSNSSGSTSGSIPRNFDGYRSPLPTNESQPLSLFPTGFP

SEQ ID NO: 851276 - protein, 928 aa, Homo sapiens [sequence omitted]

SEQ ID NO: 851277 - protein, 935 aa, Homo sapiens [sequence omitted]

SEQ ID NO: 851278 - protein, 1006 aa, Homo sapiens
MNEAMATDSPRRPSRCTGGVVVRPQAVTEQSYMESVVTFLQDVVPQAYSGTPLTEEKEKIVWVRFENADLNDTSRNLEFHEIHSTGSEPPLLIMIGYSDGMQVWSIPISGEAQELFSVRHGPIRAARILPAPQFGAQKCDNFAEKRPLLGVCKSIGSSGTSPPYCCVDLYSLRTGEMVKSIQFKTPIYDLHCNKRILVVVLQEKIAAFDSCTFTKKFFVTSCYPCPGPNMNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAGLVPPGSPGPITRHGSYDSLASDHSGQEDEEWLSQVEIVTHTGPHRRLWMGPQFQFKTIHPSGQTTVISSSSSVLQSHGPSDTPQPLLDFDTDDLDLNSLRIQPVRSDPVSMPGSSRPVSDRRGVSTVIDAASVDSSTALEWGTSRPSHSRSAHHPSVQGARSSAHLKPQGLMETIHSHSRMSQHCMQPAMATGRRVRHGPWSCRLTCPRLSQDRAQDLTEEASQQGTFDRSVTLLEVCGSWPEGFGLRHMSSMEHTEEGLRERLADAMAESPSRDVVGSGTELQREGSIETLSNSSGSTSGSIPRNFDGYRSPLPTNESQPLSLFPTGFP

SEQ ID NO: 851279 - protein, 123 aa, Homo sapiens; identical to SEQ ID NO: 851270

SEQ ID NO: 851280 - protein, 248 aa, Homo sapiens
MAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 851281 - protein, 248 aa, Homo sapiens; identical to SEQ ID NO: 851280

SEQ ID NO: 851282 - protein, 276 aa, Homo sapiens
MAQLKYMENVGYAQEDRERMHRNIVSLAQNLLNFMIGSILDLWQCFLWFYIGSSLNGTRGKRGSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 851283 - protein, 244 aa, Homo sapiens
MAQLKYMENVGYAQEDRERMHRNIVSLAQNLLNFMIGSILDLWQCFLWFYIGSSLNGTRGKRVPAHFSNTSLHYLNAAWQLLSPYLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 851284 - protein, 159 aa, Homo sapiens
MAQLKYMENVGYAQEDRERMHRNIVSLAQNLLNFMIGSILDLWQCFLWFYIGSSLNGTRGKRGSMAAIITLLVSDPVGVLYIRSCRVLMLSDWYTMLYNPSPDYVTTVHCTHEAVYPLCTIDFILSSSWSLLHLRAQPVLGDKLPWRSGKLLRLTQSFK

SEQ ID NO: 851285 - protein, 305 aa, Homo sapiens
MACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 851286 - protein, 311 aa, Homo sapiens
MAVDIQPACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 851287 - protein, 311 aa, Homo sapiens; identical to SEQ ID NO: 851286

SEQ ID NO: 851288 - protein, 311 aa, Homo sapiens; identical to SEQ ID NO: 851286

SEQ ID NO: 851289 - protein, 324 aa, Homo sapiens
KGEIQQSLGAWVLLTVDIQPACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 851290 - protein, 248 aa, Homo sapiens; identical to SEQ ID NO: 851280

SEQ ID NO: 851291 - protein, 224 aa, Homo sapiens
MAVDIQPACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYLRLSIHLYLV

SEQ ID NO: 851292 - protein, 1446 aa, Homo sapiens
MEALRQIKDTVTMDAGRANKEVEILRKQCKALCQELKEALQEADVAKCRRDWAFQERDKIVAERDSIRTLCDNLRRERDRAVSELAEALRSLDDTRKQKNDVSRELKELKEQMESQLEKEARFRQLMAHSSHDSAIDTDSMEWETEVVEFERETEDIDLKALGFDMAEGVNEPCFPGDCGIFVTKVDKGSIADGRLRVNDWLLRINDVDLINKDKKQAIKALLNGEGAINMVVRRRKSLGGKVVTPLHINLSGQKDSGISLENGVYAAAVLPGSPAAKEGSLAVGDRIVAINGIALDNKSLNECESLLRSCQDSLTLSLLKVFPQSSSWSGQNIFENIKDSDKMLSFRAHGPEVQAHNKRNLIQHNNSTQTDIFYTDRLEDRKEPGPPGGSSSFLHKPFPGGPLQVCPQACPSASERSLSSFRSDASGDRGFGLVDVRGRRPLLPFETEVGPCGVGEASLDKADSEGSNSGGTWPKAMLSSTAVPEKLSVYKKPKQRKSIFDPNTFKRPQTPPKIDYLLPGPGPAHSPQPSKRAGPLTPPKPPRRSDSIKFQHRLETSSESEATLVGSSPSTSPPSALPPDVDPGEPMHASPPRKARVRIASSYYPEGDGDSSHLPAKKSCDEDLTSQKVDELGQKRRRPKSAPSFRPKLAPVVIPAQFLEEQKCVPASGELSPELQEWAPYSPGHSSRHSNPPLYPSRPSVGTVPRSLTPSTTVSSILRNPIYTVRSHRVGPCSSPPAARDAGPQGLHPSVQHQGRLSLDLSHRTCSDYSEMRATHGSNSLPSSARLGSSSNLQFKAERIKIPSTPRYPRSVVGSERGSVSHSECSTPPQSPLNIDTLSSCSQSQTSASTLPRIAVNPASLGERRKDRPYVEEPRHVKVQKGSEPLGISIVSGEKGGIYVSKVTVGSIAHQAGLEYGDQLLEFNGINLRSATEQQARLIIGQQCDTITILAQYNPHVHQLSSHSRSSSHLDPAGTHSTLQGSGTTTPEHPSVIDPLMEQDEGPSTPPAKQSSSRIAGDANKKTLEPRVVFIKKSQLELGVHLCGGNLHGVFVAEVEDDSPAKGPDGLVPGDLILEYGSLDVRNKTVEEVYVEMLKPRDGVRLKVQYRPEEFTKAKGLPGDSFYIRALYDRLADVEQELSFKKDDILYVDDTLPQGTFGSWMAWQLDENAQKIQRGQIPSKYVMDQEFSRRLSMSEVKDDNSATKTLSAAARRSFFRRKHKHKRSGSKDGKDLLALDAFSSDSIPLFEDSVSLAYQRVQKVDCTALRPVLILGPLLDVVKEMLVNEAPGKFCRCPLEVMKASQQAIERGVKDCLFVDYKRRSGHFDVTTVASIKEITEKNRHCLLDIAPHAIERLHHMHIYPIVIFIHYKSAKHIKEQRDPIYLRDKVTQRHSKEQFEAAQKLEQEYSRYFTGVIQGGALSSICTQILAMVNQEQNKVLWIPACPL

SEQ ID NO: 851293 - protein, 674 aa, Homo sapiens
MRATHGSNSLPSSARLGSSSNLQFKAERIKIPSTPRYPRSVVGSERGSVSHSECSTPPQSPLNIDTLSSCSQSQTSASTLPRIAVNPASLGERRKDRPYVEEPRHVKVQKGSEPLGISIVSGEKGGIYVSKVTVGSIAHQAGLEYGDQLLEFNGINLRSATEQQARLIIGQQCDTITILAQYNPHVHQLSSHSRSSSHLDPAGTHSTLQGSGTTTPEHPSVIDPLMEQDEGPSTPPAKQSSSRIAGDANKKTLEPRVVFIKKSQLELGVHLCGGNLHGVFVAEVEDDSPAKGPDGLVPGDLILEYGSLDVRNKTVEEVYVEMLKPRDGVRLKVQYRPEEFTKAKGLPGDSFYIRALYDRLADVEQELSFKKDDILYVDDTLPQGTFGSWMAWQLDENAQKIQRGQIPSKYVMDQEFSRRLSMSEVKDDNSATKTLSAAARRSFFRRKHKHKRSGSKDGKDLLALDAFSSDSIPLFEDSVSLAYQRVQKVDCTALRPVLILGPLLDVVKEMLVNEAPGKFCRCPLEVMKASQQAIERGVKDCLFVDYKRRSGHFDVTTVASIKEITEKNRHCLLDIAPHAIERLHHMHIYPIVIFIHYKSAKHIKEQRDPIYLRDKVTQRHSKEQFEAAQKLEQEYSRYFTGVIQGGALSSICTQILAMVNQEQNKVLWIPACPL

SEQ ID NO: 851294 - protein, 674 aa, Homo sapiens; identical to SEQ ID NO: 851293

SEQ ID NO: 851295 - protein, 1106 aa, Homo sapiens
MEALRQIKDTVTMDAGRANKEVEILRKQCKALCQELKEALQEADVAKCRRDWAFQERDKIVAERDSIRTLCDNLRRERDRAVSELAEALRSLDDTRKQKNDVSRELKELKEQMESQLEKEARFRQLMAHSSHDSAIDTDSMEWETEVVEFERETEDIDLKALGFDMAEGVNEPCFPGDCGIFVTKVDKGSIADGRLRVNDWLLRINDVDLINKDKKQAIKALLNGEGAINMVVRRRKSLGGKVVTPLHINLSGQKDSGISLENGVYAAAVLPGSPAAKEGSLAVGDRIVAINGIALDNKSLNECESLLRSCQDSLTLSLLKEQKCVPASGELSPELQEWAPYSPGHSSRHSNPPLYPSRPSVGTVPRSLTPSTTVSSILRNPIYTVRSHRVGPCSSPPAARDAGPQGLHPSVQHQGRLSLDLSHRTCSDYSEMRATHGSNSLPSSARLGSSSNLQFKAERIKIPSTPRYPRSVVGSERGSVSHSECSTPPQSPLNIDTLSSCSQSQTSASTLPRIAVNPASLGERRKDRPYVEEPRHVKVQKGSEPLGISIVSGEKGGIYVSKVTVGSIAHQAGLEYGDQLLEFNGINLRSATEQQARLIIGQQCDTITILAQYNPHVHQLSSHSRSSSHLDPAGTHSTLQGSGTTTPEHPSVIDPLMEQDEGPSTPPAKQSSSRIAGDANKKTLEPRVVFIKKSQLELGVHLCGGNLHGVFVAEVEDDSPAKGPDGLVPGDLILEYGSLDVRNKTVEEVYVEMLKPRDGVRLKVQYRPEEFTKAKGLPGDSFYIRALYDRLADVEQELSFKKDDILYVDDTLPQGTFGSWMAWQLDENAQKIQRGQIPSKYVMDQEFSRRLSMSEVKDDNSATKTLSAAARRSFFRRKHKHKRSGSKDGKDLLALDAFSSDSIPLFEDSVSLAYQRVQKVDCTALRPVLILGPLLDVVKEMLVNEAPGKFCRCPLEVMKASQQAIERGVKDCLFVDYKRRSGHFDVTTVASIKEITEKNRHCLLDIAPHAIERLHHMHIYPIVIFIHYKSAKHIKEQRDPIYLRDKVTQRHSKEQFEAAQKLEQEYSRYFTGVIQGGALSSICTQILAMVNQEQNKVLWIPACPL

SEQ ID NO: 851296 - protein, 427 aa, Homo sapiens
TQQKSNLELLRISLLLIESWLEPVRFLRSMFPNNLVYDTSDSDDYHLLKDLEEGIQTYGSLDVRNKTVEEVYVEMLKPRDGVRLKVQYRPEEFTKAKGLPGDSFYIRALYDRLADVEQELSFKKDDILYVDDTLPQGTFGSWMAWQLDENAQKIQRGQIPSKYVMDQEFSRRLSMSEVKDDNSATKTLSAAARRSFFRRKHKHKRSGSKDGKDLLALDAFSSDSIPLFEDSVSLAYQRVQKVDCTALRPVLILGPLLDVVKEMLVNEAPGKFCRCPLEVMKASQQAIERGVKDCLFVDYKRRSGHFDVTTVASIKEITEKNRHCLLDIAPHAIERLHHMHIYPIVIFIHYKSAKHIKEQRDPIYLRDKVTQRHSKEQFEAAQKLEQEYSRYFTGVIQGGALSSICTQILAMVNQEQNKVLWIPACPL

SEQ ID NO: 851297 - protein, 241 aa, Homo sapiens
MLNCLVSRSFFRRKHKHKRSGSKDGKDLLALDAFSSDSIPLFEDSVSLAYQRVQKVDCTALRPVLILGPLLDVVKEMLVNEAPGKFCRCPLEVMKASQQAIERGVKDCLFVDYKRRSGHFDVTTVASIKEITEKNRHCLLDIAPHAIERLHHMHIYPIVIFIHYKSAKHIKEQRDPIYLRDKVTQRHSKEQFEAAQKLEQEYSRYFTGVIQGGALSSICTQILAMVNQEQNKVLWIPACPL

SEQ ID NO: 851298 - protein, 471 aa, Homo sapiens
MEALRQIKDTVTMDAGRANKEVEILRKQCKALCQELKEALQEADVAKCRRDWAFQERDKIVAERDSIRTLCDNLRRERDRAVSELAEALRSLDDTRKQKNDVSRELKELKEQMESQLEKEARFRQLMAHSSHDSAIDTDSMEWETEVVEFERETEDIDLKALGFDMAEGVNEPCFPGDCGIFVTKVDKGSIADGRLRVNDWLLRINDVDLINKDKKQAIKALLNGEGAINMVVRRRKSLGGKVVTPLHINLSGQKDSGISLENGVYAAAVLPGSPAAKEGSLAVGDRIVAINGIALDNKSLNECESLLRSCQDSLTLSLLKVFPQSSSWSGQNIFENIKDSDKMLSFRAHGPEVQAHNKRNLIQHNNSTQTDIFYTDRLEDRKEPGPPGGSSSFLHKPFPGGPLQVCPQACPSASERSLKQFEAAQKLEQEYSRYFTGVIQGGALSSICTQILAMVNQEQNKVLWIPACPL

SEQ ID NO: 851299 - protein, 674 aa, Homo sapiens; identical to SEQ ID NO: 851293

SEQ ID NO: 851300 - protein, 1446 aa, Homo sapiens; identical to SEQ ID NO: 851292

SEQ ID NO: 851301 - protein, 1411 aa, Homo sapiens
MEALRQIKDTVTMDAGRANKEVEILRKQCKALCQELKEALQEADVAKCRRDWAFQERDKIVAERDSIRTLCDNLRRERDRAVSELAEALRSLDDTRKQKNDVSRELKELKEQMESQLEKEARFRQLMAHSSHDSAIDTDSMEWETEVVEFERETEDIDLKALGFDMAEGVNEPCFPGDCGIFVTKVDKGSIADGRLRVNDWLLRINDVDLINKDKKQAIKALLNGEGAINMVVRRRKSLGGKVVTPLHINLSGQKDSGISLENGVYAAAVLPGSPAAKEGSLAVGDRIVAINGIALDNKSLNECESLLRSCQDSLTLSLLKVFPQSSSWSGQNIFENIKDSDKMLSFRAHGPEVQAHNKRNLIQHNNSTQTDIFYTDRLEDRKEPGPPGGSSSFLHKPFPGGPLQVCPQACPSASERSLSSFRSDASGDRGFGLVDVRGRRPLLPFETEVGPCGVGEASLDKADSEGSNSGGTWPKAMLSSTAVPEKLSVYKKPKQRKSIFDPNTFKRPQTPPKIDYLLPGPGPAHSPQPSKRAGPLTPPKPPRRSDSIKFQHRLETSSESEATLVGSSPSTSPPSALPPDVDPGEPMHASPPRKARVRIASSYYPEGDGDSSHLPAKKSCDEDLTSQKVDELGQKRRRPKSAPSFRPKLAPVVIPAQFLEEQKCVPASGELSPELQEWAPYSPGHSSRHSNPPLYPSRPSVGTVPRSLTPSTTVSSILRNPIYTVRSHRVGPCSSPPAARDAGPQGLHPSVQHQGRLSLDLSHRTCSDYSEMRATHGSNSLPSSARLGSSSNLQFKAERIKIPSTPRYPRSVVGSERGSVSHSECSTPPQSPLNIDTLSSCSQSQTSASTLPRIAVNPASLGERRKDRPYVEEPRHVKVQKGSEPLGISIVSGEKGGIYVSKVTVGSIAHQAGLEYGDQLLEFNGINLRSATEQQARLIIGQQCDTITILAQYNPHVHQLSSHSRSSSHLDPAGTHSTLQGSGTTTPEHPSVIDPLMEQDEGPSTPPAKQSSSRIAGDANKKTLEPRVVFIKKSQLELGVHLCGGNLHGVFVAEVEDDSPAKGPDGLVPGDLILEYGSLDVRNKTVEEVYVEMLKPRDGVRLKVQYRPEEFTKAKGLPGDSFYIRALYDRLADVEQELSFKKDDILYVDDTLPQGTFGSWMAWQLDENAQKIQRGQIPSKYVMDQEFSRRLSMSEVKDDNSATKTLSAAARRSFFRRKHKHKRSGSKDGKDLLALDAFSSDSIPLFEDSVSLAYQRVQKVDCTALRPVLILGPLLDVVKEMLVNEAPGKFCRCPLEVMKASQQAIERGVKDCLFVDYKRRSGHFDVTTVASIKEITEKNRHCLLDIAPHAIERLHHMHIYPIVIFIHYKSAKHIKEQETPKSKDPKEQRPHKSKDPKRAKTPKEQRPQQG

SEQ ID NO: 851302 - protein, 1197 aa, Homo sapiens
MEALRQIKDTVTMDAGRANKEVEILRKQCKALCQELKEALQEADVAKCRRDWAFQERDKIVAERDSIRTLCDNLRRERDRAVSELAEALRSLDDTRKQKNDVSRELKELKEQMESQLEKEARFRQLMAHSSHDSAIDTDSMEWETEVVEFERETEDIDLKALGFDMAEGVNEPCFPGDCGIFVTKVDKGSIADGRLRVNDWLLRINDVDLINKDKKQAIKALLNGEGAINMVVRRRKSLGGKVVTPLHINLSGQKDSGISLENGVYAAAVLPGSPAAKEGSLAVGDRIVAINGIALDNKSLNECESLLRSCQDSLTLSLLKVFPQSSSWSGQNIFENIKDSDKMLSFRAHGPEVQAHNKRNLIQHNNSTQTDIFYTDRLEDRKEPGPPGGSSSFLHKPFPGGPLQVCPQACPSASERSLSSFRSDASGDRGFGLVDVRGRRPLLPFETEVGPCGVGEASLDKADSEGSNSGGTWPKAMLSSTAVPEKLSVYKKPKQRKSIFDPNTFKRPQTPPKIDYLLPGPGPAHSPQPSKRAGPLTPPKPPRRSDSIKFQHRLETSSESEATLVGSSPSTSPPSALPPDVDPGEPMHASPPRKARVRIASSYYPEGDGDSSHLPAKKSCDEDLTSQKVDELGQKRRRPKSAPSFRPKLAPVVIPAQFLEEQKCVPASGELSPELQEWAPYSPGHSSRHSNPPLYPSRPSVGTVPRSLTPSTTVSSILRNPIYTVRSHRVGPCSSPPAARDAGPQGLHPSVQHQGRLSLDLSHRTCSDYSEMRATHGSNSLPSSARLGSSSNLQFKAERIKIPSTPRYPRSVVGSERGSVSHSECSTPPQSPLNIDTLSSCSQSQTSASTLPRIAVNPASLGERRKDRPYVEEPRHVKVQKGSEPLGISIVSGEKGGIYVSKVTVGSIAHQAGLEYGDQLLEFNGINLRSATEQQARLIIGQQCDTITILAQYNPHVHQLSSHSRSSSHLDPAGTHSTLQGSGTTTPEHPSVIDPLMEQDEGPSTPPAKQSSSRIAGDANKKTLEPRVVFIKKSQLELGVHLCGGNLHGVFVAEVEDDSPAKGPDGLVPGDLILEYGSLDVRNKTVEEVYVEMLKPRDGVRLKVQYRPEEFTKAKGLPGDSFYIRALYDRLADVEQELSFKKDDILYVDDTLPQGTFGSWMAWQLDENAQKIQRGQIPSKYVMDQRIVDAAANLVV

SEQ ID NO: 851303 - protein, 869 aa, Homo sapiens
MEALRQIKDTVTMDAGRANKEVEILRKQCKALCQELKEALQEADVAKCRRDWAFQERDKIVAERDSIRTLCDNLRRERDRAVSELAEALRSLDDTRKQKNDVSRELKELKEQMESQLEKEARFRQLMAHSSHDSAIDTDSMEWETEVVEFERETEDIDLKALGFDMAEGVNEPCFPGDCGIFVTKVDKGSIADGRLRVNDWLLRINDVDLINKDKKQAIKALLNGEGAINMVVRRRKSLGGKVVTPLHINLSGQKDSGISLENGVYAAAVLPGSPAAKEGSLAVGDRIVAINGIALDNKSLNECESLLRSCQDSLTLSLLKVFPQSSSWSGQNIFENIKDSDKMLSFRAHGPEVQAHNKRNLIQHNNSTQTDIFYTDRLEDRKEPGPPGGSSSFLHKPFPGGPLQVCPQACPSASERSLSSFRSDASGDRGFGLVDVRGRRPLLPFETEVGPCGVGEASLDKADSEGSNSGGTWPKAMLSSTAVPEKLSVYKKPKQRKSIFDPNTFKRPQTPPKIDYLLPGPGPAHSPQPSKRAGPLTPPKPPRRSDSIKFQHRLETSSESEATLVGSSPSTSPPSALPPDVDPGEPMHASPPRKARVRIASSYYPEGDGDSSHLPAKKSCDEDLTSQKVDELGQKRRRPKSAPSFRPKLAPVVIPAQFLEEQKCVPASGELSPELQEWAPYSPGHSSRHSNPPLYPSRPSVGTVPRSLTPSTTVSSILRNPIYTVRSHRVGPCSSPPAARDAGPQGLHPSVQHQGRLSLDLSHRTCSDYSEMRATHGSNSLPSSARLGSSSNLQFKAERIKIPSTPRYPRSVVGSERGSVSHSECSTPPQSPLNIDTLSSCSQSQTSASTLPRIAVNPASLGERRKDS

SEQ ID NO: 851304 - protein, 674 aa, Homo sapiens; identical to SEQ ID NO: 851293

SEQ ID NO: 851305 - protein, 1103 aa, Homo sapiens
MLSFRAHGPEVQAHNKRNLIQHNNSTQTDIFYTDRLEDRKEPGPPGGSSSFLHKPFPGGPLQVCPQACPSASERSLSSFRSDASGDRGFGLVDVRGRRPLLPFETEVGPCGVGEASLDKADSEGSNSGGTWPKAMLSSTAVPEKLSVYKKPKQRKSIFDPNTFKRPQTPPKIDYLLPGPGPAHSPQPSKRAGPLTPPKPPRRSDSIKFQHRLETSSESEATLVGSSPSTSPPSALPPDVDPGEPMHASPPRKARVRIASSYYPEGDGDSSHLPAKKSCDEDLTSQKVDELGQKRRRPKSAPSFRPKLAPVVIPAQFLEEQKCVPASGELSPELQEWAPYSPGHSSRHSNPPLYPSRPSVGTVPRSLTPSTTVSSILRNPIYTVRSHRVGPCSSPPAARDAGPQGLHPSVQHQGRLSLDLSHRTCSDYSEMRATHGSNSLPSSARLGSSSNLQFKAERIKIPSTPRYPRSVVGSERGSVSHSECSTPPQSPLNIDTLSSCSQSQTSASTLPRIAVNPASLGERRKDRPYVEEPRHVKVQKGSEPLGISIVSGEKGGIYVSKVTVGSIAHQAGLEYGDQLLEFNGINLRSATEQQARLIIGQQCDTITILAQYNPHVHQLSSHSRSSSHLDPAGTHSTLQGSGTTTPEHPSVIDPLMEQDEGPSTPPAKQSSSRIAGDANKKTLEPRVVFIKKSQLELGVHLCGGNLHGVFVAEVEDDSPAKGPDGLVPGDLILEYGSLDVRNKTVEEVYVEMLKPRDGVRLKVQYRPEEFTKAKGLPGDSFYIRALYDRLADVEQELSFKKDDILYVDDTLPQGTFGSWMAWQLDENAQKIQRGQIPSKYVMDQEFSRRLSMSEVKDDNSATKTLSAAARRSFFRRKHKHKRSGSKDGKDLLALDAFSSDSIPLFEDSVSLAYQRVQKVDCTALRPVLILGPLLDVVKEMLVNEAPGKFCRCPLEVMKASQQAIERGVKDCLFVDYKRRSGHFDVTTVASIKEITEKNRHCLLDIAPHAIERLHHMHIYPIVIFIHYKSAKHIKEQRDPIYLRDKVTQRHSKEQFEAAQKLEQEYSRYFTGVIQGGALSSICTQILAMVNQEQNKVLWIPACPL

SEQ ID NO: 851306 - protein, 947 aa, Homo sapiens
YDLGSLQAPPAGFTPFSCLSLPSSWDYKRMPPRLANFCIFSRDGVSPCWPGWSRSPDLMIRPPRPPKVLGLQVGATAPGPPDVDPGEPMHASPPRKARVRIASSYYPEGDGDSSHLPAKKSCDEDLTSQKVDELGQKRRRPKSAPSFRPKLAPVVIPAQFLEEQKCVPASGELSPELQEWAPYSPGHSSRHSNPPLYPSRPSVGTVPRSLTPSTTVSSILRNPIYTVRSHRVGPCSSPPAARDAGPQGLHPSVQHQGRLSLDLSHRTCSDYSEMRATHGSNSLPSSARLGSSSNLQFKAERIKIPSTPRYPRSVVGSERGSVSHSECSTPPQSPLNIDTLSSCSQSQTSASTLPRIAVNPASLGERRKDRPYVEEPRHVKVQKGSEPLGISIVSGEKGGIYVSKVTVGSIAHQAGLEYGDQLLEFNGINLRSATEQQARLIIGQQCDTITILAQYNPHVHQLSSHSRSSSHLDPAGTHSTLQGSGTTTPEHPSVIDPLMEQDEGPSTPPAKQSSSRIAGDANKKTLEPRVVFIKKSQLELGVHLCGGNLHGVFVAEVEDDSPAKGPDGLVPGDLILEYGSLDVRNKTVEEVYVEMLKPRDGVRLKVQYRPEEFTKAKGLPGDSFYIRALYDRLADVEQELSFKKDDILYVDDTLPQGTFGSWMAWQLDENAQKIQRGQIPSKYVMDQEFSRRLSMSEVKDDNSATKTLSAAARRSFFRRKHKHKRSGSKDGKDLLALDAFSSDSIPLFEDSVSLAYQRVQKVDCTALRPVLILGPLLDVVKEMLVNEAPGKFCRCPLEVMKASQQAIERGVKDCLFVDYKRRSGHFDVTTVASIKEITEKNRHCLLDIAPHAIERLHHMHIYPIVIFIHYKSAKHIKEQRDPIYLRDKVTQRHSKEQFEAAQKLEQEYSRYFTGVIQGGALSSICTQILAMVNQEQNKVLWIPACPL

SEQ ID NO: 851307 - protein, 353 aa, Homo sapiens
MLKPRDGVRLKVQYRPEEFTKAKGLPGDSFYIRALYDRLADVEQELSFKKDDILYVDDTLPQGTFGSWMAWQLDENAQKIQRGQIPSKYVMDQEFSRRLSMSEVKDDNSATKTLSAAARRSFFRRKHKHKRSGSKDGKDLLALDAFSSDSIPLFEDSVSLAYQRVQKVDCTALRPVLILGPLLDVVKEMLVNEAPGKFCRCPLEVMKASQQAIERGVKDCLFVDYKRRSGHFDVTTVASIKEITEKNRHCLLDIAPHAIERLHHMHIYPIVIFIHYKSAKHIKEQRDPIYLRDKVTQRHSKEQFEAAQKLEQEYSRYFTGVIQGGALSSICTQILAMVNQEQNKVLWIPACPL

SEQ ID NO: 851308 - protein, 674 aa, Homo sapiens; identical to SEQ ID NO: 851293

SEQ ID NO: 851309 - protein, 1432 aa, Homo sapiens
MEALRQIKDTVTMDAGRANKEVEILRKQCKALCQELKEALQEADVAKCRRDWAFQERDKIVAERDSIRTLCDNLRRERDRAVSELAEALRSLDDTRKQKNDVSRELKELKEQMESQLEKEARFRQLMAHSSHDSAIDTDSMEWETEVVEFERETEDIDLKALGFDMAEGVNEPCFPGDCGIFVTKVDKGSIADGRLRVNDWLLRINDVDLINKDKKQAIKALLNGEGAINMVVRRRKSLGGKVVTPLHINLSGQKDSGISLENGVYAAAVLPGSPAAKEGSLAVGDRIVAINGIALDNKSLNECESLLRSCQDSLTLSLLKVFPQSSSWSGQNIFENIKDSDKMLSFRAHGPEVQAHNKRNLIQHNNSTQTDIFYTDRLEDRKEPGPPGGSSSFLHKPFPGGPLQVCPQACPSASERSLSSFRSDASGDRGFGLVDVRGRRPLLPFETEVGPCGVGEASLDKADSEGSNSGGTWPKAMLSSTAVPEKLSVYKKPKQRKSIFDPNTFKRPQTPPKIDYLLPGPGPAHSPQPSKRAGPLTPPKPPRRSDSIKFQHRLETSSESEATLVGSSPSTSPPSALPPDVDPGEPMHASPPRKARVRIASSYYPEGDGDSSHLPAKKSCDEDLTSQKVDELGQKRRRPKSAPSFRPKLAPVVIPAQFLEEQKCVPASGELSPELQEWAPYSPGHSSRHSNPPLYPSRPSVGTVPRSLTPSTTVSSILRNPIYTVRSHRVGPCSSPPAARDAGPQGLHPSVQHQGRLSLDLSHRTCSDYSEMRATHGSNSLPSSARLGSSSNLQFKAERIKIPSTPRYPRSVVGSERGSVSHSECSTPPQSPLNIDTLSSCSQSQTSASTLPRIAVNPASLGERRKDRPYVEEPRHVKVQKGSEPLGISIVSGEKGGIYVSKVTVGSIAHQAGLEYGDQLLEFNGINLRSATEQQARLIIGQQCDTITILAQYNPHVHQLSSHSRSSSHLDPAGTHSTLQGSGTTTPEHPSVIDPLMEQDEGPSTPPAKQSSSRIAGDANKKTLEPRVVFIKKSQLELGVHLCGGNLHGVFVAEVEDDSPAKGPDGLVPGDLILEYGSLDVRNKTVEEVYVEMLKPRDGVRLKVQYRPEEFTKAKGLPGDSFYIRALYDRLADVEQELSFKKDDILYVDDTLPQGTFGSWMAWQLDENAQKIQRGQIPSKYVMDQEFSRRLSMSEVKDDNSATKTLSAAARRSFFRRKHKHKRSGSKDGKDLLALDAFSSDSIPLFEDSVSLAYQRVQKVDCTALRPVLILGPLLDVVKEMLVNEAPGKFCRCPLEVMKASQQAIERGVKDCLFVDYKRRSGHFDVTTVASIKEITEKNRHCLLDIAPHAIERLHHMHIYPIVIFIHYKSAKHIKEQRDPIYLRDKVTQRHSKEQFEAAQKLEQEYSRYFTGRCAWAWSGEQAAGKEAEAS

SEQ ID NO: 851310 - protein, 1446 aa, Homo sapiens; identical to SEQ ID NO: 851292

SEQ ID NO: 851311 - protein, 1441 aa, Homo sapiens
MEALRQIKDTVTMDAGRANKEVEILRKQCKALCQELKEALQEADVAKCRRDWAFQERDKIVAERDSIRTLCDNLRRERDRAVSELAEALRSLDDTRKQKNDVSRELKELKEQMESQLEKEARFRQLMAHSSHDSAIDTDSMEWETEVVEFERETEDIDLKALGFDMAEGVNEPCFPGDCGIFVTKVDKGSIADGRLRVNDWLLRINDVDLINKDKKQAIKALLNGEGAINMVVRRRKSLGGKVVTPLHINLSGQKDSGISLENGVYAAAVLPGSPAAKEGSLAVGDRIVAINGIALDNKSLNECESLLRSCQDSLTLSLLKVFPQSSSWSGQNIFENIKDSDKMLSFRAHGPEVQAHNKRNLIQHNNSTQTDIFYTDRLEDRKEPGPPGGSSSFLHKPFPGGPLQVCPQACPSASERSLSSFRSDASGDRGFGLVDVRGRRPLLPFETEVGPCGVGEASLDKADSEGSNSGGTWPKAMLSSTAVPEKLSVYKKPKQRKSIFDPNTFKRPQTPPKIDYLLPGPGPAHSPQPSKRAGPLTPPKPPRRSDSIKFQHRLETSSESEATLVGSSPSTSPPSALPPDVDPGEPMHASPPRKARVRIASSYYPEGDGDSSHLPAKKSCDEDLTSQKVDELGQKRRRPKSAPSFRPKLAPVVIPAQFLEEQKCVPASGELSPELQEWAPYSPGHSSRHSNPPLYPSRPSVGTVPRSLTPSTTVSSILRNPIYTVRSHRVGPCSSPPAARDAGPQGLHPSVQHQGRLSLDLSHRTCSDYSEMRATHGSNSLPSSARLGSSSNLQFKAERIKIPSTPRYPRSVVGSERGSVSHSECSTPPQSPLNIDTLSSCSQSQTSASTLPRIAVNPASLGERRKDRPYVEEPRHVKVQKGSEPLGISIVSGEKGGIYVSKVTVGSIAHQAGLEYGDQLLEFNGINLRSATEQQARLIIGQQCDTITILAQYNPHVHQLSSHSRSSSHLDPAGTHSTLQGSGTTTPEHPSVIDPLMEQDEGPSTPPAKQSSSRIAGDANKKTLEPRVVFIKKSQLELGVHLCGGNLHGVFVAEVEDDSPAKGPDGLVPGDLILEYGSLDVRNKTVEEVYVEMLKPRDGVRLKVQYRPEEFTKAKGLPGDSFYIRALYDRLADVEQELSFKKDDILYVDDTLPQGTFGSWMAWQLDENAQKIQRGQIPSKYVMDQEFSRRLSMSEVKDDNSATKTLSAAARRSFFRRKHKHKRSGSKDGKDLLALDAFSSDSIPLFEDSVSLAYQRVQKVDCTALRPVLILGPLLDVVKEMLVNEAPGKFCRCPLEVMKASQQAIERGVKDCLFVDYKRRSGHFDVTTVASIKEITEKNRHCLLDIAPHAIERLHHMHIYPIVIFIHYKSAKHIKEQRPQKLLGSFFLFLFFWETELGSYTQGGVKGPFSSSKKLQPQGPGDPRAYSLRRSGDNRYRHKA

SEQ ID NO: 851312 - protein, 64 aa, Homo sapiens
GSPAPLRSSTPSWVRDAAALSPSDSVSLAYQRVQKVDCTALRPVLILGPLLDVVKEMLVNEAPG

SEQ ID NO: 851313 - protein, 89 aa, Homo sapiens
SGGLPSHGPNPKSPLPAVVAVGTVLVALSAMGFTSVGIAASSIAAKMMSTAAIANGGGVAAGSLVAILQSVGECSGQDDQSQEMIQPRG

SEQ ID NO: 851314 - protein, 104 aa, Homo sapiens
MGKESGWDSGRAAVAAVVGGVVAVGTVLVALSAMGFTSVGIAASSIAAKMMSTAAIANGGGVAAGSLVAILQSVGAAGLSVTSKVIGGFAGTALGAWLGSPPSS

SEQ ID NO: 851315 - protein, 104 aa, Homo sapiens; identical to SEQ ID NO: 851314

SEQ ID NO: 851316 - protein, 105 aa, Homo sapiens
GRPLWTREPTGPERPTIGTHRPRATRDRNPGSWPQPLSRVGSNPARFGTHRVETPPQLRQSRVKNLRNRRCTSAAAATAVPGRDLHARTRARWGGSPAPMANSAT

SEQ ID NO: 851317 - protein, 104 aa, Homo sapiens; identical to SEQ ID NO: 851314

SEQ ID NO: 851318 - protein, 104 aa, Homo sapiens; identical to SEQ ID NO: 851314

SEQ ID NO: 851319 - protein, 452 aa, Homo sapiens
MRSSSLSLSSAEHKLAEVETTEGLGVLELSGHRRPGHSPGVRTACDLWRDRRGGRFLSWRARWSPGGKARPAGNTGAWAPAEQFFPASNRTREGGGLWPPLPLQSSPAAPTMLDSSAAEQVTRLTLKLLGQKASYVIPGAHRAFAWSHRLCHGLSSSQKLEQERQNVEGGPEGLHLEPGNEDRPDDALQTALKRRRDLLQRLREQHLLDELSRAQAWSGPSRGALGSALPPELPPTGILPTASPSPLAPDPPRIILPTVPQPPATIIQQLPQQPLIAQIPPPQAFPTQRSGSIKEDMVELLLLQNAQVHQLVLQNWMLKALPPALQDPPHVPPRVPRAARQGCLPCTTTTTTTMLCGHLGLPLSSSPPPACGRLAHPECESQRPWPGHPPPPGFLRAVGCGGTMEGSRERPCHHPEWLRECGLQAPPGEAGQARFLVTGPFQGASLAPGPLQ

SEQ ID NO: 851320 - protein, 305 aa, Homo sapiens
MRSSSLSLSSAEHKLAEVETTEGLGVLELSGHRRPGHSPGVRTACDLWRDRRGGRFLSWRARWSPGGKARPAGNTGAWAPAEQFFPASNRTREGGGLWPPLPLQSSPAAPTMLDSSAAEQVTRLTLKLLGQKLEQERQNVEGGPEGLHLEPGNEDRPDDALQTALKRRRDLLQRLREQHLLDELSRAQAWSGPSRGALGSALPPELPPTGILPTASPSPLAPDPPRIILPTVPQPPATIIQQLPQQPLIAQIPPPQAFPTQRSGSIKEDMVELLLLQNAQVHQLVLQNWMLKALPPALQDRFFHS

SEQ ID NO: 851321 - protein, 128 aa, Homo sapiens
MCPSLVSGFLCSPSGPVRAPSLAKGSSWRAVCLFAAVTMPFPSVLEWLLADASSPCSLLSNCNLNAPSGSPGISLRIFFLFLRQSRCDAQAIAQWRDLGSLQPPSGSRGSSTARNFLLLTQATVFCVV

SEQ ID NO: 851322 - protein, 370 aa, Homo sapiens
MAIEYSGWSPGGKARPAGNTGAWAPAEQFFPASNRTREGGGLWPPLPLQSSPAAPTMLDSSAAEQVTRLTLKLLGQKLEQERQNVEGGPEGLHLEPGNEDRPDDALQTALKRRRDLLQRLREQHLLDELSRAQAWSGPSRGALGSALPPELPPTGILPTASPSPLAPDPPRIILPTVPQPPATIIQQLPQQPLIAQIPPPQAFPTQRSGSIKEDMVELLLLQNAQVHQLVLQNWMLKALPPALQDPPHVPPRVPRAARQGCLPCTTTTTTTMLCGHLGLPLSSSPPPACGRLAHPECESQRPWPGHPPPPGFLRAVGCGGTMEGSRERPCHHPEWLRECGLQAPPGEAGQARFLVTGPFQGASLAPGPLQ

SEQ ID NO: 851323 - protein, 314 aa, Homo sapiens
MLDSSAAEQVTRLTLKLLGQKLEQERQNVEGGPEGLHLEPGNEDRPDDALQTALKRRRDLLQRLREQHLLDELSRAQAWSGPSRGALGSALPPELPPTGILPTASPSPLAPDPPRIILPTVPQPPATIIQQLPQQPLIAQIPPPQAFPTQRSGSIKEDMVELLLLQNAQVHQLVLQNWMLKALPPALQDPPHVPPRVPRAARQGCLPCTTTTTTTMLCGHLGLPLSSSPPPACGRLAHPECESQRPWPGHPPPPGFLRAVGCGGTMEGSRERPCHHPEWLRECGLQAPPGEAGQARFLVTGPFQGASLAPGPLQ

SEQ ID NO: 851324 - protein, 425 aa, Homo sapiens
MRSSSLSLSSAEHKLAEVETTEGLGVLELSGHRRPGHSPGVRTACDLWRDRRGGRFLSWRARWSPGGKARPAGNTGAWAPAEQFFPASNRTREGGGLWPPLPLQSSPAAPTMLDSSAAEQVTRLTLKLLGQKLEQERQNVEGGPEGLHLEPGNEDRPDDALQTALKRRRDLLQRLREQHLLDELSRAQAWSGPSRGALGSALPPELPPTGILPTASPSPLAPDPPRIILPTVPQPPATIIQQLPQQPLIAQIPPPQAFPTQRSGSIKEDMVELLLLQNAQVHQLVLQNWMLKALPPALQDPPHVPPRVPRAARQGCLPCTTTTTTTMLCGHLGLPLSSSPPPACGRLAHPECESQRPWPGHPPPPGFLRAVGCGGTMEGSRERPCHHPEWLRECGLQAPPGEAGQARFLVTGPFQGASLAPGPLQ

SEQ ID NO: 851325 - protein, 350 aa, Homo sapiens
MRSSSLSLSSAEHKLAEVETTEGLGVLELSGHRRPGHSPGVRTACDLWRDRRGGRFLSWRARWSPGGKARPAGNTGAWAPAEQFFPASNRTREGGGLWPPLPLQSSPAAPTMLDSSAAEQVTRLTLKLLGQKLEQERQNVEGGPEGLHLEPGNEDRPDDALQTALKRRRDLLQRLREQHLLDELSRAQAWSGPSRGALGSALPPELPPTGILPTASPSPLAPDPPRIILPTVPQPPATIIQQLPQQPLIAQIPPPQAFPTQRSGSIKEDMVELLLLQNAQVHQLVLQNWMLKALPPALQDPPHVPPRVPRAARPRLPAVHHHHHHHHAVWPPGAATVLQPAPSLWTPGPP

SEQ ID NO: 851326 - protein, 215 aa, Homo sapiens
RYWRHFLQGHMQIANHLAVPRSPSLLPPSFSSSLSEPLIAQIPPPQAFPTQRSGSIKEDMVELLLLQNAQVHQLVLQNWMLKALPPALQDPPHVPPRVPRAARQGCLPCTTTTTTTMLCGHLGLPLSSSPPPACGRLAHPECESQRPWPGHPPPPGFLRAVGCGGTMEGSRERPCHHPEWLRECGLQAPPGEAGQARFLVTGPFQGASLAPGPLQ

SEQ ID NO: 851327 - protein, 1097 aa, Homo sapiens
MMDIYVCLKRPSWMVDNKRMRTASNFQWLLSTFILLYLMNQVNSQKKGAPHDLKCVTNNLQVWNCSWKAPSGTGRGTDYEVCIENRSRSCYQLEKTSIKIPALSHGDYEITINSLHDFGSSTSKFTLNEQNVSLIPDTPEILNLSADFSTSTLYLKWNDRGSVFPHRSNVIWEIKVLRKESMELVKLVTHNTTLNGKDTLHHWSWASDMPLECAIHFVEIRCYIDNLHFSGLEEWSDWSPVKNISWIPDSQTKVFPQDKVILVGSDITFCCVSQEKVLSALIGHTNCPLIHLDGENVAIKIRNISVSASSGTNVVFTTEDNIFGTVIFAGYPPDTPQQLNCETHDLKEIICSWNPGRVTALVGPRATSYTLVESFSGKYVRLKRAEAPTNESYQLLFQMLPNQEIYNFTLNAHNPLGRSQSTILVNITEKVYPHTPTSFKVKDINSTAVKLSWHLPGNFAKINFLCEIEIKKSNSVQEQRNVTIKGVENSSYLVALDKLNPYTLYTFRIRCSTETFWKWSKWSNKKQHLTTEASPSKGPDTWREWSSDGKNLIIYWKPLPINEANGKILSYNVSCSSDEETQSLSEIPDPQHKAEIRLDKNDYIISVVAKNSVGSSPPSKIASMEIPNDDLKIEQVVGMGKGILLTWHYDPNMTCDYVIKWCNSSRSEPCLMDWRKVPSNSTETVIESDEFRPGIRYNFFLYGCRNQGYQLLRSMIGYIEELAPIVAPNFTVEDTSADSILVKWEDIPVEELRGFLRGYLFYFGKGERDTSKMRVLESGRSDIKVKNITDISQKTLRIADLQGKTSYHLVLRAYTDGGVGPEKSMYVVTKENSVGLIIAILIPVAVAVIVGVVTSILCYRKREWIKETFYPDIPNPENCKALQFQKSVCEGSSALKTLEMNPCTPNNVEVLETRSAFPKIEDTEIISPVAERPEDRSDAEPENHVVVSYCPPIIEEEIPNPAADEAGGTAQVIYIDVQSMYQPQAKPEEEQENDPVGGAGYKPQMHLPINSTVEDIAAEEDLDKTAGYRPQANVNTWNLVSPDSPRSIDSNSEIVSFGSPCSINSRQFLIPPKDEDSPKSNGGGWSFTNFFQNKPND

SEQ ID NO: 851328 - protein, 623 aa, Homo sapiens
MMDIYVCLKRPSWMVDNKRMRTASNFQWLLSTFILLYLMNQVNSQKKGAPHDLKCVTNNLQVWNCSWKAPSGTGRGTDYEVCIENRSRSCYQLEKTSIKIPALSHGDYEITINSLHDFGSSTSKFTLNEQNVSLIPDTPEILNLSADFSTSTLYLKWNDRGSVFPHRSNVIWEIKVLRKESMELVKLVTHNTTLNGKDTLHHWSWASDMPLECAIHFVEIRCYIDNLHFSGLEEWSDWSPVKNISWIPDSQTKVFPQDKVILVGSDITFCCVSQEKVLSALIGHTNCPLIHLDGENVAIKIRNISVSASSGTNVVFTTEDNIFGTVIFAGYPPDTPQQLNCETHDLKEIICSWNPGRVTALVGPRATSYTLVESFSGKYVRLKRAEAPTNESYQLLFQMLPNQEIYNFTLNAHNPLGRSQSTILVNITEKVYPHTPTSFKVKDINSTAVKLSWHLPGNFAKINFLCEIEIKKSNSVQEQRNVTIKGVENSSYLVALDKLNPYTLYTFRIRCSTETFWKWSKWSNKKQHLTTEASPSKGPDTWREWSSDGKNLIIYWKPLPINEANGKILSYNVSCSSDEETQSLSEIPDPQHKAEIRLDKEMAYLHSVMGLKILGGPSINPFS

SEQ ID NO: 851329 - protein, 1406 aa, Homo sapiens
GTGVVPRSWPRAGGRRRRLPACYGMDEEENHYVSQLREVYSSCDTTGTGFLDRQELTQLCLKLHLEQQLPVLLQTLLGNDHFARVNFEEFKEGFVAVLSSNAGVRPSDEDSSSLESAASSAIPPKYVNGSKWYGRRSRPELCDAATEARRVPEQQTQASLKSHLWRSASLESVESPKSDEEAESTKEAQNELFEAQGQLQTWDSEDFGSPQKSCSPSFDTPESQIRGVWEELGVGSSGHLSEQELAVVCQSVGLQGLEKEELEDLFNKLDQDGDGKVSLEEFQLGLFSHEPALLLESSTRVKPSKAWSHYQVPEESGCHTTTTSSLVSLCSSLRLFSSIDDGSGFAFPDQVLAMWTQEGIQNGREILQSLDFSVDEKVNLLELTWALDNELMTVDSAVQQAALACYHQELSYQQGQVEQLARERDKARQDLERAEKRNLEFVKEMDDCHSTLEQLTEKKIKHLEQGYRERLSLLRSEVEAERELFWEQAHRQRAALEWDVGRLQAEEAGLREKLTLALKENSRLQKEIVEVVEKLSDSERLALKLQKDLEFVLKDKLEPQSAELLAQEERFAAVLKEYELKCRDLQDRNDELQAELEGLWARLPKNRHSPSWSPDGRRRQLPGLGPAGISFLGNSAPVSIETELMMEQVKEHYQDLRTQLETKVNYYEREIAALKRNFEKERKDMEQARRREVSVLEGQKADLEELHEKSQEVIWGLQEQLQDTARGPEPEQMGLAPCCTQALCGLALRHHSHLQQIRREAEAELSGELSGLGALPARRDLTLELEEPPQGPLPRGSQRSEQLELERALKLQPCASEKRAQMCVSLALEEEELELARGKRVDGPSLEAEMQALPKDGLVAGSGQEGTRGLLPLRPGCGERPLAWLAPGDGRESEEAAGAGPRRRQAQDTEATQSPAPAPAPASHGPSERWSRMQPCGVDGDIVPKEPEPFGASAAGLEQPGARELPLLGTERDASQTQPRMWEPPLRPAASCRGQAERLQAIQEERARSWSRGTQEQASEQQARAEGALEPGCHKHSVEVARRGSLPSHLQLADPQGSWQEQLAAPEEGETKIALEREKDDMETKLLHLEDVVRALEKHVDLRENDRLEFHRLSEENTLLKNDLGRVRQELEAAESTHDAQRKEIEVLKKDKEKACSEMEVLNRQNQNYKDQLSQLNVRVLQLGQEASTHQAQNEEHRVTIQMLTQSLEEVVRSGQQQSDQIQKLRVELECLNQEHQSLQLPWSELTQTLEESQDQVQGAHLRLRQAQAQHLQEVRLVPQDRVAELHRLLSLQGEQARRRLDAQREEHEKQLKATEERVEEAEMILKNMEMLLQEKVDKLKEQFEKNTKSDLLLKELYVENAHLVRALQATEEKQRGAEKQSRLLEEKVRALNKLVSRIAPAALSV

SEQ ID NO: 851330 - protein, 173 aa, Homo sapiens
MERVLLCAASQQPHQSCLPFPMQVQGAHLRLRQAQAQHLQEVRLVPQDRVAELHRLLSLQGEQARRRLDAQREEHEKQLKATEERVEEAEMILKNMEMLLQEKVDKLKEQFEKNTKSDLLLKELYVENAHLVRALQATEEKQRGAEKQSRLLEEKVRALNKLVSRIAPAALSV

SEQ ID NO: 851331 - protein, 1295 aa, Homo sapiens
GTGVVPRSWPRAGGRRRRLPACYGMDEEENHYVSQLREVYSSCDTTGTGFLDRQELTQLCLKLHLEQQLPVLLQTLLGNDHFARVNFEEFKEGFVAVLSSNAGVRPSDEDSSSLESAASSAIPPKYVNGSKWYGRRSRPELCDAATEARRVPEQQTQASLKSHLWRSASLESVESPKSDEEAESTKEAQNELFEAQGQLQTWDSEDFGSPQKSCSPSFDTPESQIRGVWEELGVGSSGHLSEQELAVVCQSVGLQGLEKEELEDLFNKLDQDGDGKVSLEEFQLGLFSHEPALLLESSTRVKPSKAWSHYQVPEESGCHTTTTSSLVSLCSSLRLFSSIDDGSGFAFPDQHLEQGYRERLSLLRSEVEAERELFWEQAHRQRAALEWDVGRLQAEEAGLREKLTLALKENSRLQKEIVEVVEKLSDSERLALKLQKDLEFVLKDKLEPQSAELLAQEERFAAVLKEYELKCRDLQDRNDELQAELEGLWARLPKNRHSPSWSPDGRRRQLPGLGPAGISFLGNSAPVSIETELMMEQVKEHYQDLRTQLETKVNYYEREIAALKRNFEKERKDMEQARRREVSVLEGQKADLEELHEKSQEVIWGLQEQLQDTARGPEPEQMGLAPCCTQALCGLALRHHSHLQQIRREAEAELSGELSGLGALPARRDLTLELEEPPQGPLPRGSQRSEQLELERALKLQPCASEKRAQMCVSLALEEEELELARGKRVDGPSLEAEMQALPKDGLVAGSGQEGTRGLLPLRPGCGERPLAWLAPGDGRESEEAAGAGPRRRQAQDTEATQSPAPAPAPASHGPSERWSRMQPCGVDGDIVPKEPEPFGASAAGLEQPGARELPLLGTERDASQTQPRMWEPPLRPAASCRGQAERLQAIQEERARSWSRGTQEQASEQQARAEGALEPGCHKHSVEVARRGSLPSHLQLADPQGSWQEQLAAPEEGETKIALEREKDDMETKLLHLEDVVRALEKHVDLRENDRLEFHRLSEENTLLKNDLGRVRQELEAAESTHDAQRKEIEVLKKDKEKACSEMEVLNRQNQNYKDQLSQLNVRVLQLGQEASTHQAQNEEHRVTIQMLTQSLEEVVRSGQQQSDQIQKLRVELECLNQEHQSLQLPWSELTQTLEESQDQVQGAHLRLRQAQAQHLQEVRLVPQDRVAELHRLLSLQGEQARRRLDAQREEHEKQLKATEERVEEAEMILKNMEMLLQEKVDKLKEQFEKNTKSDLLLKELYVENAHLVRALQATEEKQRGAEKQSRLLEEKVRALNKLVSRIAPAALSV

SEQ ID NO: 851332 - protein, 1068 aa, Homo sapiens
GTGVVPRSWPRAGGRRRRLPACYGMDEEENHYVSQLREVYSSCDTTGTGFLDRQELTQLCLKLHLEQQLPVLLQTLLGNDHFARVNFEEFKEGFVAVLSSNAGVRPSDEDSSSLESAASSAIPPKYVNGSKWYGRRSRPELCDAATEARRVPEQQTQASLKSHLWRSASLESVESPKSDEEAESTKEAQNELFEAQGQLQTWDSEDFGSPQKSCSPSFDTPESQIRGVWEELGVGSSGHLSEQELAVVCQSVGLQGLEKEELEDLFNKLDQDGDGKVSLEEFQLGLFSHEPALLLESSTRVKPSKAWSHYQVPEESGCHTTTTSSLVSLCSSLRLFSSIDDGSGFAFPDQVLAMWTQEGIQNGREILQSLDFSVDEKVNLLELTWALDNELMTVDSAVQQAALACYHQELSYQQGQVEQLARERDKARQDLERAEKRNLEFVKEMDDCHSTLEQLTEKKIKHLEQGYRERLSLLRSEVEAERELFWEQAHRQRAALEWDVGRLQAEEAGLREKLTLALKEPDEPLACVSKENSRLQKEIVEVVEKLSDSERLALKLQKDLEFVLKDKLEPQSAELLAQEERFAAVLKEYELKCRDLQDRNDELQAELEGLWARLPKNRHSPSWSPDGRRRQLPGLGPAGISFLGNSAPVSIETELMMEQVKEHYQDLRTQLETKVNYYEREIAALKRNFEKERKDMEQARRREVSVLEGQKADLEELHEKSQEVIWGLQEQLQDTARGPEPEQMGLAPCCTQALCGLALRHHSHLQQIRLEFHRLSEENTLLKNDLGRVRQELEAAESTHDAQRKEIEVLKKDKEKACSEMEVLNRQNQNYKDQLSQLNVRVLQLGQEASTHQAQNEEHRVTIQMLTQSLEEVVRSGQQQSDQIQKLRVELECLNQEHQSLQLPWSELTQTLEESQDQVQGAHLRLRQAQAQHLQEVRLVPQDRVAELHRLLSLQGEQARRRLDAQREEHEKQLKATEERVEEAEMILKNMEMLLQEKVDKLKEQFEKNTKSDLLLKELYVENAHLVRALQATEEKQRGAEKQSRLLEEKVRALNKLVSRIAPAALSV

SEQ ID NO: 851333 - protein, 268 aa, Homo sapiens
MAQRKEIEVLKKDKEKACSEMEVLNRQNQNYKDQLSQLNVRVLQLGQEASTHQAQNEEHRVTIQMLTQSLEEVVRSGQQQSDQIQKLRVELECLNQEHQSLQLPWSELTQTLEESQDQVQGAHLRLRQAQAQHLQEVRLVPQDRVAELHRLLSLQGEQARRRLDAQREEHEKQLKATEERVEEAEMILKNMEMLLQEKVDKLKEQFEKNTKSDLLLKELYVENAHLVRALQATEEKQRGAEKQSRLLEEKVRALNKLVSRIAPAALSV

SEQ ID NO: 851334 - protein, 636 aa, Homo sapiens
GTGVVPRSWPRAGGRRRRLPACYGMDEEENHYVSQLREVYSSCDTTGTGFLDRQELTQLCLKLHLEQQLPVLLQTLLGNDHFARVNFEEFKEGFVAVLSSNAGVRPSDEDSSSLESAASSAIPPKYVNGSKWYGRRSRPELCDAATEARRVPEQQTQASLKSHLWRSASLESVESPKSDEEAESTKEAQNELFEAQGQLQTWDSEDFGSPQKSCSPSFDTPESQIRGVWEELGVGSSGHLSEQELAVVCQSVGLQGLEKEELEDLFNKLDQDGDGKVSLEEFQLGLFSHEPALLLESSTRVKPSKAWSHYQVPEESGCHTTTTSSLVSLCSSLRLFSSIDDGSGFAFPDQVLAMWTQEGIQNGREILQSLDFSVDEKVNLLELTWALDNELMTVDSAVQQAALACYHQELSYQQGQVEQLARERDKARQDLERAEKRNLEFVKEMDDCHSTLEQLTEKKIKHLEQGYRERLSLLRSEVEAERELFWEQAHRQRAALEWDVGRLQAEEAGLREKLTLALKENSRLQKEIVEVVEKLSDSERLALKLQKDLEFVLKDKLEPQSAELLAQEERFAAVLKEYELKCRDLQDRNDELQAELEGLWARLPKNRHSPSWSPDGRRRQLPGLGPAGRSPSLGGG

SEQ ID NO: 851335 - protein, 484 aa, Homo sapiens
GTGVVPRSWPRAGGRRRRLPACYGMDEEENHYVSQLREVYSSCDTTGTGFLDRQELTQLCLKLHLEQQLPVLLQTLLGNDHFARVNFEEFKEGFVAVLSSNAGVRPSDEDSSSLESAASSAIPPKYVNGSKWYGRRSRPELCDAATEARRVPEQQTQASLKSHLWRSASLESVESPKSDEEAESTKEAQNELFEAQGQLQTWDSEDFGSPQKSCSPSFDTPESQIRGVWEELGVGSSGHLSEQELAVVCQSVGLQGLEKEELEDLFNKLDQDGDGKVSLEEFQLGLFSHEPALLLESSTRVKPSKAWSHYQVPEESGCHTTTTSSLVSLCSSLRLFSSIDDGSGFAFPDQVLAMWTQEGIQNGREILQSLDFSVDEKVNLLELTWALDNELMTVDSAVQQAALACYHQELSYQQGQVEQLARERDKARQDLERAEKRNLEFVKEMDDCHSTLEQLTEKKIKKTVAYRRRLWKWWKSFRIRRGWP

SEQ ID NO: 851336 - protein, 1417 aa, Homo sapiens
GTGVVPRSWPRAGGRRRRLPACYGMDEEENHYVSQLREVYSSCDTTGTGFLDRQELTQLCLKLHLEQQLPVLLQTLLGNDHFARVNFEEFKEGFVAVLSSNAGVRPSDEDSSSLESAASSAIPPKYVNGSKWYGRRSRPELCDAATEARRVPEQQTQASLKSHLWRSASLESVESPKSDEEAESTKEAQNELFEAQGQLQTWDSEDFGSPQKSCSPSFDTPESQIRGVWEELGVGSSGHLSEQELAVVCQSVGLQGLEKEELEDLFNKLDQDGDGKVSLEEFQLGLFSHEPALLLESSTRVKPSKAWSHYQVPEESGCHTTTTSSLVSLCSSLRLFSSIDDGSGFAFPDQVLAMWTQEGIQNGREILQSLDFSVDEKVNLLELTWALDNELMTVDSAVQQAALACYHQELSYQQGQVEQLARERDKARQDLERAEKRNLEFVKEMDDCHSTLEQLTEKKIKHLEQGYRERLSLLRSEVEAERELFWEQAHRQRAALEWDVGRLQAEEAGLREKLTLALKEPDEPLACVSKENSRLQKEIVEVVEKLSDSERLALKLQKDLEFVLKDKLEPQSAELLAQEERFAAVLKEYELKCRDLQDRNDELQAELEGLWARLPKNRHSPSWSPDGRRRQLPGLGPAGISFLGNSAPVSIETELMMEQVKEHYQDLRTQLETKVNYYEREIAALKRNFEKERKDMEQARRREVSVLEGQKADLEELHEKSQEVIWGLQEQLQDTARGPEPEQMGLAPCCTQALCGLALRHHSHLQQIRREAEAELSGELSGLGALPARRDLTLELEEPPQGPLPRGSQRSEQLELERALKLQPCASEKRAQMCVSLALEEEELELARGKRVDGPSLEAEMQALPKDGLVAGSGQEGTRGLLPLRPGCGERPLAWLAPGDGRESEEAAGAGPRRRQAQDTEATQSPAPAPAPASHGPSERWSRMQPCGVDGDIVPKEPEPFGASAAGLEQPGARELPLLGTERDASQTQPRMWEPPLRPAASCRGQAERLQAIQEERARSWSRGTQEQASEQQARAEGALEPGCHKHSVEVARRGSLPSHLQLADPQGSWQEQLAAPEEGETKIALEREKDDMETKLLHLEDVVRALEKHVDLRENDRLEFHRLSEENTLLKNDLGRVRQELEAAESTHDAQRKEIEVLKKDKEKACSEMEVLNRQNQNYKDQLSQLNVRVLQLGQEASTHQAQNEEHRVTIQMLTQSLEEVVRSGQQQSDQIQKLRVELECLNQEHQSLQLPWSELTQTLEESQDQVQGAHLRLRQAQAQHLQEVRLVPQDRVAELHRLLSLQGEQARRRLDAQREEHEKQLKATEERVEEAEMILKNMEMLLQEKVDKLKEQFEKNTKSDLLLKELYVENAHLVRALQATEEKQRGAEKQSRLLEEKVRALNKLVSRIAPAALSV

SEQ ID NO: 851337 - protein, 584 aa, Homo sapiens
MCVSLALEEEELELARGKRVDGPSLEAEMQALPKDGLVAGSGQEGTRGLLPLRPGCGERPLAWLAPGDGRESEEAAGAGPRRRQAQDTEATQSPAPAPAPASHGPSERWSRMQPCGVDGDIVPKEPEPFGASAAGLEQPGARELPLLGTERDASQTQPRMEPPLRPAASCRGQAERLQAIQEERARSWSRGTQEQASEQQARAEGALEPGCHKHSVEVARRGSLPSHLQLADPQGSWQEQLAAPEEGETKIALEREKDDMETKLLHLEDVVRALEKHVDLRENDRLEFHRLSEENTLLKNDLGRVRQELEAAESTHDAQRKEIEVLKKDKEKACSEMEVLNRQNQNYKDQLSQLNVRVLQLGQEASTHQAQNEEHRVTIQMLTQSLEEVVRSGQQQSDQIQKLRVELECLNQEHQSLQLPWSELTQTLEESQDQVQGAHLRLRQAQAQHLQEVRLVPQDRVAELHRLLSLQGEQARRRLDAQREEHEKQLKATEERVEEAEMILKNMEMLLQEKVDKLKEQFEKNTKSDLLLKELYVENAHLVRALQATEEKQRGAEKQSRLLEEKVRALNKLVSRIAPAALSV

SEQ ID NO: 851338 - protein, 210 aa, Homo sapiens
MSGFFNWDRRLLPTRPKRGASCDHSDVNTEPGGGGSQWAAAGLQLPWSELTQTLEESQDQVQGAHLRLRQAQAQHLQEVRLVPQDRVAELHRLLSLQGEQARRRLDAQREEHEKQLKATEERVEEAEMILKNMEMLLQEKVDKLKEQFEKNTKSDLLLKELYVENAHLVRALQATEEKQRGAEKQSRLLEEKVRALNKLVSRIAPAALSV

SEQ ID NO: 851339 - protein, 1399 aa, Homo sapiens
GTGVVPRSWPRAGGRRRRLPACYGMDEEENHYVSQLREVYSSCDTTGTGFLDRQELTQLCLKLHLEQQLPVLLQTLLGNDHFARVNFEEFKEGFVAVLSSNAGVRPSDEDSSSLESAASSAIPPKYVNGSKWYGRRSRPELCDAATEARRVPEQQTQASLKSHLWRSASLESVESPKSDEEAESTKEAQNELFEAQGQLQTWDSEDFGSPQKSCSPSFDTPESQIRGVWEELGVGSSGHLSEQELAVVCQSVGLQGLEKEELEDLFNKLDQDGDGKVSLEEFQLGLFSHEPALLLESSTRVKPSKAWSHYQVPEESGCHTTTTSSLVSLCSSLRLFSSIDDGSGFAFPDQVLAMWTQEGIQNGREILQSLDFSVDEKVNLLELTWALDNELMTVDSAVQQAALACYHQELSYQQGQVEQLARERDKARQDLERAEKRNLEFVKEMDDCHSTLEQLTEKKIKHLEQGYRERLSLLRSEVEAERELFWEQAHRQRAALEWDVGRLQAEEAGLREKLTLALKEPDEPLACVSKENSRLQKEIVEVVEKLSDSERLALKLQKDLEFVLKDKLEPQSAELLAQEERFAAVLKEYELKCRDLQDRNDELQAELEGLWARLPKNRHSPSWSPDGRRRQLPGLGPAGISFLGNSAPVSIETELMMEQVKEHYQDLRTQLETKVNYYEREIAALKRNFEKERKDMEQARRREVSVLEGQKADLEELHEKSQEVIWGLQEQLQDTARGPEPEQMGLAPCCTQALCGLALRHHSHLQQIRREAEAELSGELSGLGALPARRDLTLELEEPPQGPLPRGSQRSEQLELERALKLQPCASEKRAQMCVSLALEEEELELARGKRVDGPSLEAEMQALPKDGLVAGSGQEGTRGLLPLRPGCGERPLAWLAPGDGRESEEAAGAGPRRRQAQDTEATQSPAPAPAPASHGPSERWSRMQPCGVDGDIVPKEPEPFGASAAGLEQPGARELPLLGTERDASQTQPRMWEPPLRPAASCRGQAERLQAIQEERARSWSRGTQEQASEQQARAEGALEPGCHKHSVEVARRGSLPSHLQLADPQGSWQEQLAAPEEGETKIALEREKDDMETKLLHLEDVVRALEKHVDLRENDRLEFHRLSEENTLLKNDLGRVRQELEAAESTHDAQRKEIEVLKKDKEKACSEMEVLNRQNQNYKDQLSQLNVRVLQLGQEASTHQAQNEEHRVTIQMLTQSLEEVVRSGQQQSDQIQKLRVELECLNQEHQSLQLPWSELTQTLEESQDQVQGAHLRLRQAQAQHLQEVRLVPQDRVAELHRLLSLQGEQARRRLDAQREEHEKQLKATEERVEEAEMILKNMEMLLQEKVDKLKEQFEKNTKSDLLLKELYVENAHLVRALQATEEKQRGAEKQSRLLEDV

SEQ ID NO: 851340 - protein, 182 aa, Homo sapiens
MTMDKSELVQKAKLAEQAERYDDMAAAMKAVTEQGHELSNEERNLLSVAYKNVVGARRSSWRVISSIEQKTERNEKKQQMGKEYREKIEAELQDICNDVLELLDKYLIPNATQPESKVFYLNNEHGDYFRYLSEVASGDNKQTTVSNSQQAYQEAFEISKNRNAAYTPNSSWSGTKFLSLLL

SEQ ID NO: 851341 - protein, 124 aa, Homo sapiens
VRVYRCHILLKMAYGDNNKPLCRTPSRLTRKHLKLVRTEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 851342 - protein, 182 aa, Homo sapiens; identical to SEQ ID NO: 851340

SEQ ID NO: 851343 - protein, 182 aa, Homo sapiens; identical to SEQ ID NO: 851340

SEQ ID NO: 851344 - protein, 182 aa, Homo sapiens; identical to SEQ ID NO: 851340

SEQ ID NO: 851345 - protein, 182 aa, Homo sapiens; identical to SEQ ID NO: 851340

SEQ ID NO: 851346 - protein, 182 aa, Homo sapiens; identical to SEQ ID NO: 851340

SEQ ID NO: 851347 - protein, 247 aa, Homo sapiens
VAAAAAAAAAAAAARVEARGRRARVSCSHCRHRCRRLSSGLRKEEVISLGASLGRVFVPCSPPTGMTMDKSELVQKAKLAEQAERYDDMAAAMKAVTEQGHELSNEERNLLSVAYKNVVGARRSSWRVISSIEQKTERNEKKQQMGKEYREKIEAELQDICNDVLELLDKYLIPNATQPESKVFYLNNEHGDYFRYLSEVASGDNKQTTVSNSQQAYQEAFEISKNRNAAYTPNSSWSGTKFLSLLL

SEQ ID NO: 851348 - protein, 186 aa, Homo sapiens
MAGGMTMDKSELVQKAKLAEQAERYDDMAAAMKAVTEQGHELSNEERNLLSVAYKNVVGARRSSWRVISSIEQKTERNEKKQQMGKEYREKIEAELQDICNDVLELLDKYLIPNATQPESKVFYLNNEHGDYFRYLSEVASGDNKQTTVSNSQQAYQEAFEISKNRNAAYTPNSSWSGTKFLSLLL

SEQ ID NO: 851349 - protein, 182 aa, Homo sapiens; identical to SEQ ID NO: 851340

SEQ ID NO: 851350 - protein, 149 aa, Homo sapiens
MTMDKSELVQKAKLAEQAERYDDMAAAMKAVTEQGHELSNEERNLLSVAYKNVVGARRSSWRVISSIEQKTERNEKKQQMGKEYREKIEAELQDICNDVLFFRMPHSKTTLRKYCSVYEAWTPSELLLLSCWTNILFPMLHNQKVRCST

SEQ ID NO: 851351 - protein, 124 aa, Homo sapiens; identical to SEQ ID NO: 851341

SEQ ID NO: 851352 - protein, 69 aa, Homo sapiens
HEFQESLEFHSKRLYLAKTAFDEAIAELDTLNEESYKDSTLIMQLLRDNLTLWTSENQGDEGDAGEGEN

SEQ ID NO: 851353 - protein, 125 aa, Homo sapiens
MNTEIILGIFLKWHLETTNKPLCRTPSRLTRKHLKLVRTEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 851354 - protein, 182 aa, Homo sapiens; identical to SEQ ID NO: 851340

SEQ ID NO: 851355 - protein, 182 aa, Homo sapiens; identical to SEQ ID NO: 851340

SEQ ID NO: 851356 - protein, 182 aa, Homo sapiens; identical to SEQ ID NO: 851340

SEQ ID NO: 851357 - protein, 182 aa, Homo sapiens; identical to SEQ ID NO: 851340

SEQ ID NO: 851358 - protein, 182 aa, Homo sapiens; identical to SEQ ID NO: 851340

SEQ ID NO: 851359 - protein, 212 aa, Homo sapiens
LFPMLQNIIDLQFSLYLLTVLFVPCSPPTGMTMDKSELVQKAKLAEQAERYDDMAAAMKAVTEQGHELSNEERNLLSVAYKNVVGARRSSWRVISSIEQKTERNEKKQQMGKEYREKIEAELQDICNDVLELLDKYLIPNATQPESKVFYLNNEHGDYFRYLSEVASGDNKQTTVSNSQQAYQEAFEISKNRNAAYTPNSSWSGTKFLSLLL

SEQ ID NO: 851360 - protein, 182 aa, Homo sapiens; identical to SEQ ID NO: 851340

SEQ ID NO: 851361 - protein, 183 aa, Homo sapiens
SLCLQLSQHPTIILGDMKGIFEQVLSATTDPFRCSCICSQDYAILIGPPRDGRANFPGLWKLVSPCCAKSGSKTAIPAAVIQREASTLVGQYTEHSREMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 851362 - protein, 85 aa, Homo sapiens
SRKGAREHGAVRCGGRRAGRRGEPPGSIKGLVYSSNFQNVKQLYALVCETQRYSAVLDAVISSAGLLSAKKLQPHLAKGRGGAGK

SEQ ID NO: 851363 - protein, 117 aa, Homo sapiens
MPSRQLEDPGAGTPSPVRLHALAGFQQRALCHALTFPSLQRLVYSMCSLCQEENEDMVPDALQQNPGAFRLAPALPARPHRGLSTFPGAEHCLRASPKTTLSGGFFVAVIERVEMPT

SEQ ID NO: 851364 - protein, 117 aa, Homo sapiens; identical to SEQ ID NO: 851363

SEQ ID NO: 851365 - protein, 117 aa, Homo sapiens; identical to SEQ ID NO: 851363

SEQ ID NO: 851366 - protein, 117 aa, Homo sapiens; identical to SEQ ID NO: 851363

SEQ ID NO: 851367 - protein, 117 aa, Homo sapiens; identical to SEQ ID NO: 851363

SEQ ID NO: 851368 - protein, 141 aa, Homo sapiens
SRKGAREHGAVRCGGRRAGRRGEPPGSIKGLVYSSNFQNVKQLYALVCETQRYSAVLDAVISSAGLLSAKKLQPHLAKASQLPRFVRVNTLKTCSVYVVISRDKVSPIRVGLPGWMECPGAISAHRNLCLLGSSDSPASAF

SEQ ID NO: 851369 - protein, 117 aa, Homo sapiens; identical to SEQ ID NO: 851363

SEQ ID NO: 851370 - protein, 117 aa, Homo sapiens; identical to SEQ ID NO: 851363

SEQ ID NO: 851371 - protein, 85 aa, Homo sapiens; identical to SEQ ID NO: 851362

SEQ ID NO: 851372 - protein, 117 aa, Homo sapiens; identical to SEQ ID NO: 851363

SEQ ID NO: 851373 - protein, 95 aa, Homo sapiens
SRKGAREHGAVRCGGRRAGRRGEPPGSIKGLVYSSNFQNVKQLYALVCETQRYSAVLDAVISSAGLLSAKKLQPHLAKALMTYKPSRGSIFSWTP

SEQ ID NO: 851374 - protein, 85 aa, Homo sapiens; identical to SEQ ID NO: 851362

SEQ ID NO: 851375 - protein, 60 aa, Homo sapiens
MHHRCHSRCIHLSSQTLHLVHPQFNLTDVTVFHPFGQATVNPQATVNPQATVNPQATVNP

SEQ ID NO: 851376 - protein, 117 aa, Homo sapiens; identical to SEQ ID NO: 851363

SEQ ID NO: 851377 - protein, 85 aa, Homo sapiens; identical to SEQ ID NO: 851362

SEQ ID NO: 851378 - protein, 117 aa, Homo sapiens; identical to SEQ ID NO: 851363

SEQ ID NO: 851379 - protein, 82 aa, Homo sapiens
SRKGAREHGAVRCGGRRAGRRGEPPGSIKGLVYSSNFQNVKQLYALVCETQRYSAVLDAVISSAGLLSAKKLQPHLAKGASV

SEQ ID NO: 851380 - protein, 117 aa, Homo sapiens; identical to SEQ ID NO: 851363

SEQ ID NO: 851381 - protein, 117 aa, Homo sapiens; identical to SEQ ID NO: 851363

SEQ ID NO: 851382 - protein, 117 aa, Homo sapiens; identical to SEQ ID NO: 851363

SEQ ID NO: 851383 - protein, 106 aa, Homo sapiens
SRKGAREHGAVRCGGRRAGRRGEPPGSIKGLVYSSNFQNVKQLYALVCETQRYSAVLDAVISSAGLLSAKKLQPHLAKGWMECPGAISAHRNLCLLGSSDSPASAF

SEQ ID NO: 851384 - protein, 85 aa, Homo sapiens; identical to SEQ ID NO: 851362

SEQ ID NO: 851385 - protein, 519 aa, Homo sapiens
MEGVLYKWTNYLSGWQPRWFLLCGGILSYYDSPEDAWKGCKGSIQMAVCEIQVHSVDNTRMDLIIPGEQYFYLKARSVAERQRWLVALGSAKACLTDSRTQKEKEFAENTENLKTKMSELRLYCDLLVQQVDKTKEVTTTGVSNSEEGIDVGTLLKSTCNTFLKTLEECMQIANAAFTSELLYRTPPGSPQLAMLKSSKMKHPIIPIHNSLERQMELSTCENGSLNMEINGEEEILMKNKNSLYLKSAEIDCSISSEENTDDNITVQGEIRKEDGMENLKNHDNNLTQSGSDSSCSPECLWEEGKEVIPTFFSTMNTSFSDIELLEDSGIPTEAFLASCYAVVPVLDKLGPTVFAPVKMDLVGNIKKVNQKYITNKEEFTTLQKIVLHEVEADVAQVRNSATEALLWLKRGLKFLKGFLTEVKNGEKDIQTALNNAYGKTLRQHHGWVVRGVFALALRAAPSYEDFVAALTVKEGDHQKEAFSIGMQRDLSLYLPAMEKQLAILDTLYEVHGLESDEVV

SEQ ID NO: 851386 - protein, 459 aa, Homo sapiens
MEGVLYKWTNYLSGWQPRWFLLCGGILSYYDSPEDAWKGCKGSIQMAVCEIQVHSVDNTRMDLIIPGEQYFYLKARSVAERQRWLVALGSAKACLTDSRTQKEKEFAENTENLKTKMSELRLYCDLLVQQVDKTKEVTTTGVSNSEEGIDVGTLLKSTCNTFLKTLEECMQIANAAFTSELLYRTPPGSPQLAMLKSSKMKHPIIPIHNSLERQMELSTCENGSLNMEINGEEEILMKNKNSLYLKSAEIDCSISSEENTDDNITVQGEIRKEDGMENLKNHDNNLTQSGSDSSCSPECLWEEGKEVIPTFFSTMNTSFSDIELLEDSGIPTEAFLASCYAVVPVLDKLGPTVFAPVKMDLVGNIKKVNQKYITNKEEFTTLQKIVLHEVEADVAQVRNSATEALLWLKRGLKFLKGFLTEVKNGEKDIQTALNNAYGKTLRQHHGWVVRGVFAGHTNV

SEQ ID NO: 851387 - protein, 455 aa, Homo sapiens
MEGVLYKWTNYLSGWQPRWFLLCGGILSYYDSPEDAWKGCKGSIQMAVCEIQVHSVDNTRMDLIIPGEQYFYLKARSVAERQRWLVALGSAKACLTDSRTQKEKEFAENTENLKTKMSELRLYCDLLVQQVDKTKEVTTTGVSNSEEGIDVGTLLKSTCNTFLKTLEECMQIANAAFTSELLYRTPPGSPQLAMLKSSKMKHPIIPIHNSLERQMELSTCENGSLNMEINGEEEILMKNKNSLYLKSAEIDCSISSEENTDDNITVQGEIRKEDGMENLKNHDNNLTQSGSDSSCSPECLWEEGKEVIPTFFSTMNTSFSDIELLEDSGIPTEAFLASCYAVVPVLDKLGPTVFAPVKMDLVGNIKKVNQKYITNKEEFTTLQKIVLHEVEADVAQVRNSATEALLWLKRGLKFLKGFLTEVKNGEKDIQTALNNAYGKTLRQHHGWVVRGVFAV

SEQ ID NO: 851388 - protein, 440 aa, Homo sapiens
MEGVLYKWTNYLSGWQPRWFLLCGGILSYYDSPEDAWKGCKGSIQMAVCEIQVHSVDNTRMDLIIPGEQYFYLKARSVAERQRWLVALGSAKACLTDSRTQKEKEFAENTENLKTKMSELRLYCDLLVQQVDKTKEVTTTGVSNSEEGIDVGTLLKSTCNTFLKTLEECMQIANAAFTSELLYRTPPGSPQLAMLKSSKMKHPIIPIHNSLERQMELSTCENGSLNMEINGEEEILMKNKNSLYLKSAEIDCSISSEENTDDNITVQGEIRKEDGMENLKNHDNNLTQSGSDSSCSPECLWEEGKEVIPTFFSTMNTSFSDIELLEDSGIPTEAFLASCYAVVPVLDKLGPTVFAPVKMDLVGNIKKVNQKYITNKEEFTTLQKIVLHEVEADVAQVRNSATEALLWLKRGLKFLKGFLTEVKNGEKDIQTALRNPTENT

SEQ ID NO: 851389 - protein, 439 aa, Homo sapiens
MEGVLYKWTNYLSGWQPRWFLLCGGILSYYDSPEDAWKGCKGSIQMAVCEIQVHSVDNTRMDLIIPGEQYFYLKARSVAERQRWLVALGSAKACLTDSRTQKEKEFAENTENLKTKMSELRLYCDLLVQQVDKTKEVTTTGVSNSEEGIDVGTLLKSTCNTFLKTLEECMQIANAAFTSELLYRTPPGSPQLAMLKSSKMKHPIIPIHNSLERQMELSTCENGSLNMEINGEEEILMKNKNSLYLKSAEIDCSISSEENTDDNITVQGEIRKEDGMENLKNHDNNLTQSGSDSSCSPECLWEEGKEVIPTFFSTMNTSFSDIELLEDSGIPTEAFLASCYAVVPVLDKLGPTVFAPVKMDLVGNIKKVNQKYITNKEEFTTLQKIVLHEVEADVAQVRNSATEALLWLKRGLKFLKGFLTEVKNGEKDIQTALSVGMWV

SEQ ID NO: 851390 - protein, 101 aa, Homo sapiens
HFHESPLYESVSHMPVTRGNVHTFPRVTPCPGTLSRHCNHKMLFIELAPGLGRGLPYSEQPTQERSSRERPGQGPCPNTNTSSPAQSSGSRPACPFFRKHF

SEQ ID NO: 851391 - protein, 101 aa, Homo sapiens
SAAAEGDANRPGPIRAAVARVPREFGSPGRQGNGLRCGLRAAGARLPRGGAADRRPRHGEAARPQETRGRDREEGKVRILPAPQVWTANLESWFLKFCLRF

SEQ ID NO: 851392 - protein, 101 aa, Homo sapiens; identical to SEQ ID NO: 851391

SEQ ID NO: 851393 - protein, 113 aa, Homo sapiens
MDEKRGAPTNTRARYIKTANESERITNTRNRQETTDNSKNEPARKNQDNHQTEGEKNRERDNKHHTKSRKTARHEKNNNTIERTTEEPQQRDSTEPDQKQNIDTRENRTNTIQ

SEQ ID NO: 851394 - protein, 70 aa, Homo sapiens
SAAAEGDANRPGPIRAAVARVPREFGSPGRQGNGLRCGLRAAGARLPRGGAADRRPRHGEAARPQNSRTD

SEQ ID NO: 851395 - protein, 101 aa, Homo sapiens; identical to SEQ ID NO: 851391

SEQ ID NO: 851396 - protein, 101 aa, Homo sapiens; identical to SEQ ID NO: 851391

SEQ ID NO: 851397 - protein, 101 aa, Homo sapiens; identical to SEQ ID NO: 851391

SEQ ID NO: 851398 - protein, 160 aa, Homo sapiens
MTRFKCHHLKGPVSLPSCALGPWKCGGCWPQERRGLSHPWPGGSIQSPRQPRSHAQGTWPALHSPVAAPKAIASGIPGGCCPGQRCQEASAEGTGLPGSRPGRPGCHTTAGAWSASSSTKRLRPPVLSPHSLVGLGRCRWSVPRGLWSGPGRALTVCLCP

SEQ ID NO: 851399 - protein, 1275 aa, Homo sapiens
MLRSTGFFRAIDCPYWSGAPGGPCRRPYCHFRHRGARGPGAPGDGGEAPPAAVKAAPDASVPALCGSVCGTGSEDSESEGGGVEAAWDGCETALQDLGLSMAPSVTGLGYDPYNPELPKPPAQRENGTLGLGEEPRPDVLELELVNQAIEAVRSEVELEQRRYRELLETTREHRSAEAPALAPRGPNASPTVGPDEDAFPLAFDYSPGSHGLLSPDAGYQPTPLAAPAEPGSKYSLASLDRGQGRGGGGGGALEYVPKAVSQPRRHSRPVPSGKYVVDNSRPPTDLEYDPLSNYSARHLSRASSRDERAAKRPRGSRGSEPYTPAPKKLCDPFGSCDARFSDSEDEAATVPGNEPTTASTPKARADPEIKATGQPPSKEGLEAEGGGLRETKETAVQCDVGDLQPPPAKPASPAQVQSSQDGGCPKEGKPKKKKTGAPPAPSCKDGAQGKDKTKDKGRGRPVEKPRADKKGPQASSPRRKAERPEGTKKKPSSATPVATSGKGRPDRPARRPSPTSGDSRPAAGRGPPRPLQLPDRKSTKAPSGKLVERKARSLDEGASQDAPKLKKRALSHADLFGDESEDEAAGPGVPSVWPSALPSLSSDSDSDSDSSLGFPEAQGPPKRLKASPPPSPAPSSSSSSSSSTSSAGADVDYSALEKEVDFDSDPMEECLRIFNESTSVKTEDRGRLARQPPKEEKSEEKGLSGLTTLFPGQKRRISHLSKQGQEVEPPRRGPAVPPARPPTAQEVCYLRAQQAQRASASLLQAPARLAEKSPSVHISAPGEKRRIAHIPNPRLAAAPTGAKRTLAASGSQSSNGPEPGGQQLKTRTLSGMASKTTTTIIPKRIAHSPSLQSLKKPIIPKEFGGKVPTVIRQRYLNLFIEECLKFCTSNQEAIEKALNEEKVAYDRSPSKNIYLNVAVNTLKKLRGLAPSAVPGLSKTSGRRVVSHEVVLGGRLAAKTSFSLSRPSSPRVEDLKGAALYSRLREYLLTQDQLKENGYPFPHPERPGGAIIFTAEEKRPKDSSCRTCCRCGTEYLVSSSGRCIRDEECYYHWGRLRRNRVAGGWETQYMCCSAAAGSVGCQVAKQHVQDGRKERLEGFVKTFEKELSGDTHPGIYALDCEMSYTTYGLELTRVTVVDTDVHVVYDTFVKPDNEIVDYNTRFSGVTEADLADTSVTLRDVQAVLLSMFSADTILIGHSLESDLLALKVIHSTVVDTSVLFPHRLGLPYKRSLRNLMADYLRQIIQDNVDGHSSSEDAGACMHLVIWKVREDAKTKR

SEQ ID NO: 851400 - protein, 1227 aa, Homo sapiens
MLRSTGFFRAIDCPYWSGAPGGPCRRPYCHFRHRGARGPGAPGDGGEAPPAAGLGYDPYNPELPKPPAQRENGTLGLGEEPRPDVLELELVNQAIEAVRSEVELEQRRYRELLETTREHRSAEAPALAPRGPNASPTVGPDEDAFPLAFDYSPGSHGLLSPDAGYQPTPLAAPAEPGSKYSLASLDRGQGRGGGGGGALEYVPKAVSQPRRHSRPVPSGKYVVDNSRPPTDLEYDPLSNYSARHLSRASSRDERAAKRPRGSRGSEPYTPAPKKLCDPFGSCDARFSDSEDEAATVPGNEPTTASTPKARADPEIKATGQPPSKEGLEAEGGGLRETKETAVQCDVGDLQPPPAKPASPAQVQSSQDGGCPKEGKPKKKKTGAPPAPSCKDGAQGKDKTKDKGRGRPVEKPRADKKGPQASSPRRKAERPEGTKKKPSSATPVATSGKGRPDRPARRPSPTSGDSRPAAGRGPPRPLQLPDRKSTKAPSGKLVERKARSLDEGASQDAPKLKKRALSHADLFGDESEDEAAGPGVPSVWPSALPSLSSDSDSDSDSSLGFPEAQGPPKRLKASPPPSPAPSSSSSSSSSTSSAGADVDYSALEKEVDFDSDPMEECLRIFNESTSVKTEDRGRLARQPPKEEKSEEKGLSGLTTLFPGQKRRISHLSKQGQEVEPPRRGPAVPPARPPTAQEVCYLRAQQAQRASASLLQAPARLAEKSPSVHISAPGEKRRIAHIPNPRLAAAPTGAKRTLAASGSQSSNGPEPGGQQLKTRTLSGMASKTTTTIIPKRIAHSPSLQLLPSLQSLKKPIIPKEFGGKVPTVIRQRYLNLFIEECLKFCTSNQEAIEKALNEEKVAYDRSPSKNIYLNVAVNTLKKLRGLAPSAVPGLSKTSGRRVVSHEVVLGGRLAAKTSFSLSRPSSPRVEDLKGAALYSRLREYLLTQDQLKENGYPFPHPERPGGAIIFTAEEKRPKDSSCRTCCRCGTEYLVSSSGRCIRDEECYYHWGRLRRNRVAGGWETQYMCCSAAAGSVGCQVAKQHVQDGRKERLEGFVKTFEKELSGDTHPGIYALDCEMSYTTYGLELTRVTVVDTDVHVVYDTFVKPDNEIVDYNTRFSGVTEADLADTSVTLRDVQAVLLSMFSADTILIGHSLESDLLALKVIHSTVVDTSVLFPHRLGLPYKRSLRNLMADYLRQIIQDNVDGHSSSEDAGACMHLVIWKVREDAKTKR

SEQ ID NO: 851401 - protein, 1401 aa, Homo sapiens
MLRSTGFFRAIDCPYWSGAPGGPCRRPYCHFRHRGARGPGAPGDGGEAPPAAGLGYDPYNPELPKPPAQRENGTLGLGEEPRPDVLELELVNQAIEAVRSEVELEQRRYRELLETTREHRSAEAPALAPRGPNASPTVGPDEDAFPLAFDYSPGSHGLLSPDAGYQPTPLAAPAEPGSKYSLASLDRGQGRGGGGGGALEYVPKAVSQPRRHSRPVPSGKYVVDNSRPPTDLEYDPLSNYSARHLSRASSRDERAAKRPRGSRGSEPYTPAPKKLCDPFGSCDARFSDSEDEAATVPGNEPTTASTPKARADPEIKATGQPPSKEGLEAEGGGLRETKETAVQCDVGDLQPPPAKPASPAQVQSSQDGGCPKEGKPKKKKTGAPPAPSCKDGAQGKDKTKDKGRGRPVEKPRADKKGPQASSPRRKAERPEGTKKKPSSATPVATSGKGRPDRPARRPSPTSGDSRPAAGRGPPRPLQLPDRKSTKAPSGKLVERKARSLDEGASQDAPKLKKRALSHADLFGDESEDEAAGPGVPSVWPSALPSLSSDSDSDSDSSLGFPEAQGPPKRLKASPPPSPAPSSSSSSSSSTSSAGADVDYSALEKEVDFDSDPMEECLRIFNESTSVKTEDRGRLARQPPKEEKSEEKGLSGLTTLFPGQKRRISHLSKQGQEVEPPRRGPAVPPARPPTAQEVCYLRAQQAQRASASLLQAPARLAEKSPSVHISAPGEKRRIAHIPNPRLAAAPTGAKRTLAASGSQSSNGPEPGGQQLKTRTLSGMASKTTTTIIPKRIAHSPSLQSLKKPIIPKEFGGKVPTVIRQRYLNLFIEECLKFCTSNQEAIEKALNEEKVAYDRSPSKNIYLNVAVNTLKKLRGLAPSAVPGLSKTSGRRVVSHEVVLGGRLAAKTSFSLSRPSSPRVEDLKGAALYSRLREYLLTQDQLKENGYPFPHPERPGGAIIFTAEEKRPKDSSCRTCCRCGTEYLVSSSGRCIRDEECYYHWGRLRRNRVAGGWETQYMCCSAAAGSVGCQVAKQHVQDGRKERLEGFVKTFEKELSGDTHPGIYALDCEMSYTTYGLELTRVTVVDTDVHVVYDTFVKPDNEIVDYNTRFSGVTEADLADTSVTLRDVQAVLLSMFSADTILIGHSLESDLLALKVPCRPGPARFSSRTCAGPTCADLCRCPQVIHSTVVDTSVLFPHRLGLPYKRSLRNLMADYLRQIIQDNGECRCLPWGRPCAGAGCSPHLPRSGWAQLQRGRRRLHAPGDLEGSRRRQDQAMTPARLPPASPAVPLVLSPMPLPKQCNKSPVTRPPGRGSPEQRDELAARERPAQPTPAHVLPHPSAGPHPLPPSPLASLETAADGDQDRARPHPARSPSCPSCQALPPGWWPAPLLLTWVAGRACPRFV

SEQ ID NO: 851402 - protein, 1249 aa, Homo sapiens
MLRSTGFFRAIDCPYWSGAPGGPCRRPYCHFRHRGARGPGAPGDGGEAPPAAGLGYDPYNPELPKPPAQRENGTLGLGEEPRPDVLELELVNQAIEAVRSEVELEQRRYRELLETTREHRSAEAPALAPRGPNASPTVGPDEDAFPLAFDYSPGSHGLLSPDAGYQPTPLAAPAEPGSKYSLASLDRGQGRGGGGGGALEYVPKAVSQPRRHSRPVPSGKYVVDNSRPPTDLEYDPLSNYSARHLSRASSRDERAAKRPRGSRGSEPYTPAPKKLCDPFGSCDARFSDSEDEAATVPGNEPTTASTPKARADPEIKATGQPPSKEGLEAEGGGLRETKETAVQCDVGDLQPPPAKPASPAQVQSSQDGGCPKEGKPKKKKTGAPPAPSCKDGAQGKDKTKDKGRGRPVEKPRADKKGPQASSPRRKAERPEGTKKKPSSATPVATSGKGRPDRPARRPSPTSGDSRPAAGRGPPRPLQLPDRKSTKAPSGKLVERKARSLDEGASQDAPKLKKRALSHADLFGDESEDEAAGPGVPSVWPSALPSLSSDSDSDSDSSLGFPEAQGPPKRLKASPPPSPAPSSSSSSSSSTSSAGADVDYSALEKEVDFDSDPMEECLRIFNESTSVKTEDRGRLARQPPKEEKSEEKGLSGLTTLFPGQKRRISHLSKQGQEVEPPRRGPAVPPARPPTAQEVCYLRAQQAQRASASLLQAPARLAEKSPSVHISAPGEKRRIAHIPNPRLAAAPTGAKRTLAASGSQSSNGPEPGGQQLKTRTLSGMASKTTTTIIPKRIAHSPSLQSLKKPIIPKEFGGKVPTVIRQRYLNLFIEECLKFCTSNQEAIEKALNEEKVAYDRSPSKNIYLNVAVNTLKKLRGLAPSAVPGLSKTSGRRVVSHEVVLGGRLAAKTSFSLSRPSSPRVEDLKGAALYSRLREYLLTQDQLKENGYPFPHPERPGGAIIFTAEEKRPKDSSCRTCCRCGTEYLVSSSGRCIRDEECYYHWGRLRRNRVAGGWETQYMCCSAAAGSVGCQVAKQHVQDGRKERLEGFVKTFEKELSGDTHPGIYALDCEMSYTTYGLELTRVTVVDTDVHVVYDTFVKPDNEIVDYNTRFSGVTEADLADTSVTLRDVQAVLLSMFSADTILIGHSLESDLLALKVPCRPGPARFSSRTCAGPTCADLCRCPQVIHSTVVDTSVLFPHRLGLPYKRSLRNLMADYLRQIIQDNVDGHSSSEDAGACMHLVIWKVREDAKTKR

SEQ ID NO: 851403 - protein, 1221 aa, Homo sapiens
MLRSTGFFRAIDCPYWSGAPGGPCRRPYCHFRHRGARGPGAPGDGGEAPPAAGLGYDPYNPELPKPPAQRENGTLGLGEEPRPDVLELELVNQAIEAVRSEVELEQRRYRELLETTREHRSAEAPALAPRGPNASPTVGPDEDAFPLAFDYSPGSHGLLSPDAGYQPTPLAAPAEPGSKYSLASLDRGQGRGGGGGGALEYVPKAVSQPRRHSRPVPSGKYVVDNSRPPTDLEYDPLSNYSARHLSRASSRDERAAKRPRGSRGSEPYTPAPKKLCDPFGSCDARFSDSEDEAATVPGNEPTTASTPKARADPEIKATGQPPSKEGLEAEGGGLRETKETAVQCDVGDLQPPPAKPASPAQVQSSQDGGCPKEGKPKKKKTGAPPAPSCKDGAQGKDKTKDKGRGRPVEKPRADKKGPQASSPRRKAERPEGTKKKPSSATPVATSGKGRPDRPARRPSPTSGDSRPAAGRGPPRPLQLPDRKSTKAPSGKLVERKARSLDEGASQDAPKLKKRALSHADLFGDESEDEAAGPGVPSVWPSALPSLSSDSDSDSDSSLGFPEAQGPPKRLKASPPPSPAPSSSSSSSSSTSSAGADVDYSALEKEVDFDSDPMEECLRIFNESTSVKTEDRGRLARQPPKEEKSEEKGLSGLTTLFPGQKRRISHLSKQGQEVEPPRRGPAVPPARPPTAQEVCYLRAQQAQRASASLLQAPARLAEKSPSVHISAPGEKRRIAHIPNPRLAAAPTGAKRTLAASGSQSSNGPEPGGQQLKTRTLSGMASKTTTTIIPKRIAHSPSLQSLKKPIIPKEFGGKVPTVIRQRYLNLFIEECLKFCTSNQEAIEKALNEEKVAYDRSPSKNIYLNVAVNTLKKLRGLAPSAVPGLSKTSGRRVVSHEVVLGGRLAAKTSFSLSRPSSPRVEDLKGAALYSRLREYLLTQDQLKENGYPFPHPERPGGAIIFTAEEKRPKDSSCRTCCRCGTEYLVSSSGRCIRDEECYYHWGRLRRNRVAGGWETQYMCCSAAAGSVGCQVAKQHVQDGRKERLEGFVKTFEKELSGDTHPGIYALDCEMSYTTYGLELTRVTVVDTDVHVVYDTFVKPDNEIVDYNTRFSGVTEADLADTSVTLRDVQAVLLSMFSADTILIGHSLESDLLALKVIHSTVVDTSVLFPHRLGLPYKRSLRNLMADYLRQIIQDNVDGHSSSEDAGACMHLVIWKVREDAKTKR

SEQ ID NO: 851404 - protein, 1080 aa, Homo sapiens
MLRSTGFFRAIDCPYWSGAPGGPCRRPYCHFRHRGARGPGAPGDGGEAPPAAGLGYDPYNPELPKPPAQRENGTLGLGEEPRPDVLELELVNQAIEAVRSEVELEQRRYRELLETTREHRSAEAPALAPRGPNASPTVGPDEDAFPLAFDYSPGSHGLLSPDAGYQPTPLAAPAEPGSKYSLASLDRGQGRGGGGGGALEYVPKAVSQPRRHSRPVPSGKYVVDNSRPPTDLEYDPLSNYSARHLSRASSRDERAAKRPRGSRGSEPYTPAPKKLCDPFGSCDARFSDSEDEAATVPGNEPTTASTPKARADPEIKATGQPPSKEGLEAEGGGLRETKETAVQCDVGDLQPPPAKPASPAQVQSSQDGGCPKEGKPKKKKTGAPPAPSCKDGAQGKDKTKDKGRGRPVEKPRADKKGPQASSPRRKAERPEGTKKKPSSATPVATSGKGRPDRPARRPSPTSGDSRPAAGRGPPRPLQLPDRKSTKAPSGKLVERKARSLDEGASQDAPKLKKRALSHADLFGDESEDEAAGPGVPSVWPSALPSLSSDSDSDSDSSLGFPEAQGPPKRLKASPPPSPAPSSSSSSSSSTSSAGADVDYSALEKEVDFDSDPMEECLRIFNESTSVKTEDRGRLARQPPKEEKSEEKGLSGLTTLFPGQKRRISHLSKQGQEVEPPRRGPAVPPARPPTAQEVCYLRAQQAQRASASLLQAPARLAEKSPSVHISAPGEKRRIAHIPNPRLAAAPTGAKRTLAASGSQSSNGPEPGGQQLKTRTLSGMASKTTTTIIPKRIAHSPSLQSLKKPIIPKEFGGKVPTVIRQRYLNLFIEECLKFCTSNQEAIEKALNEEKVAYDRSPSKNIYLNVAVNTLKKLRGLAPSAVPGLSKTSGRRVVSHEVVLGGRLAAKTSFSLSRPSSPRVEDLKGAALYSRLREYLLTQDQLKENGYPFPHPERPGGAIIFTAEEKRPKDSSCRTCCRCGTEYLVSSSGRCIRDEECYYHWGRLRRNRVAGGWETQYMCCSAAAGSVGCQVAKQHVQDGRKERLEGFVKTFEKELSGDTHPGIYALDCEMVRLFSAQRRVQDW

SEQ ID NO: 851405 - protein, 97 aa, Homo sapiens
GRGCLVLRHVVMGSHSPCAHTPCAPPAPTGAKRTLAASGSQSSNGPEPGGQQLKTRTLSGMASKTTTTIIPKRIAHSPSLQVAPPISARTTTPKTTP

SEQ ID NO: 851406 - protein, 1221 aa, Homo sapiens; identical to SEQ ID NO: 851403

SEQ ID NO: 851407 - protein, 96 aa, Homo sapiens
RIGGAPGRRAWRDLQSHCYGEEEGQGMLHTLTFEKQLHKPSEIRFQQRRTGSEDSESEGGGVEAAWDGCETALQDLGLSMAPSVTGKGDFTPSRAP

SEQ ID NO: 851408 - protein, 424 aa, Homo sapiens
MSLKKPIIPKEFGGKVPTVIRQRYLNLFIEECLKFCTSNQEAIEKALNEEKVAYDRSPSKNIYLNVAVNTLKKLRGLAPSAVPGLSKTSGRRVVSHEVVLGGRLAAKTSFSLSRPSSPRVEDLKGAALYSRLREYLLTQDQLKENGYPFPHPERPGGAIIFTAEEKRPKDSSCRTCCRCGTEYLVSSSGRCIRDEECYYHWGRLRRNRVAGGWETQYMCCSAAAGSVGCQVAKQHVQDGRKERLEGFVKTFEKELSGDTHPGIYALDCEMSYTTYGLELTRVTVVDTDVHVVYDTFVKPDNEIVDYNTRFSGVTEADLADTSVTLRDVQAVLLSMFSADTILIGHSLESDLLALKVIHSTVVDTSVLFPHRLGLPYKRSLRNLMADYLRQIIQDNVDGHSSSEDAGACMHLVIWKVREDAKTKR

SEQ ID NO: 851409 - protein, 1221 aa, Homo sapiens; identical to SEQ ID NO: 851403

SEQ ID NO: 851410 - protein, 559 aa, Homo sapiens
MTLVPLPSVSPAAPVLPWRVCPYCSQADLSQRTSLLPPAMGTASSRLRSPLEALWRPSPMAAFAFPLEFKETHYPQRVWGQSPHRHPPALSQPVHRGVSQVLYLQPGGHREGEVLEFLSGRSGGDYGVQGGPQTSPGLSAAAVTRSCLGEMQVPDPMATPPLGLPGTRQAWPQLGTAFPQALNEEKVAYDRSPSKNIYLNVAVNTLKKLRGLAPSAVPGLSKTSGRRVVSHEVVLGGRLAAKTSFSLSRPSSPRVEDLKGAALYSRLREYLLTQDQLKENGYPFPHPERPGGAIIFTAEEKRPKDSSCRTCCRCGTEYLVSSSGRCIRDEECYYHWGRLRRNRVAGGWETQYMCCSAAAGSVGCQVAKQHVQDGRKERLEGFVKTFEKELSGDTHPGIYALDCEMSYTTYGLELTRVTVVDTDVHVVYDTFVKPDNEIVDYNTRFSGVTEADLADTSVTLRDVQAVLLSMFSADTILIGHSLESDLLALKVIHSTVVDTSVLFPHRLGLPYKRSLRNLMADYLRQIIQDNVDGHSSSEDAGACMHLVIWKVREDAKTKR

SEQ ID NO: 851411 - protein, 1034 aa, Homo sapiens
MLRSTGFFRAIDCPYWSGAPGGPCRRPYCHFRHRGARGPGAPGDGGEAPPAAGLGYDPYNPELPKPPAQRENGTLGLGEEPRPDVLELELVNQAIEAVRSEVELEQRRYRELLETTREHRSAEAPALAPRGPNASPTVGPDEDAFPLAFDYSPGSHGLLSPDAGYQPTPLAAPAEPGSKYSLASLDRGQGRGGGGGGALEYVPKAVSQPRRHSRPVPSGKYVVDNSRPPTDLEYDPLSNYSARHLSRASSRDERAAKRPRGSRGSEPYTPAPKKLCDPFGSCDARFSDSEDEAATVPGNEPTTASTPKARADPEIKATGQPPSKEGLEAEGGGLRETKETAVQCDVGDLQPPPAKPASPAQVQSSQDGGCPKEGKPKKKKTGAPPAPSCKDGAQGKDKTKDKGRGRPVEKPRADKKGPQASSPRRKAERPEGTKKKPSSATPVATSGKGRPDRPARRPSPTSGDSRPAAGRGPPRPLQLPDRKSTKAPSGKLVERKARSLDEGASQDAPKLKKRALSHADLFGDESEDEAAGPGVPSVWPSALPSLSSDSDSDSDSSLGFPEAQGPPKRLKASPPPSPAPSSSSSSSSSTSSAGADVDYSALEKEVDFDSDPMEECLRIFNESTSVKTEDRGRLARQPPKEEKSEEKGLSGLTTLFPGQKRRISHLSKQGQEVEPPRRGPAVPPARPPTAQEVCYLRAQQAQRASASLLQAPARLAEKSPSVHISAPGEKRRIAHIPNPRLAAAPTGAKRTLAASGSQSSNGPEPGGQQLKTRTLSGMASKTTTTIIPKRIAHSPSLQSLKKPIIPKEFGGKVPTVIRQRYLNLFIEECLKFCTSNQEAIEKALNEEKVAYDRSPSKNIYLNVAVNTLKKLRGLAPSAVPGLSKTSGRRVVSHEVVLGGRLAAKTSFSLSRPSSPRVEDLKGAALYSRLREYLLTQDQLKENGYPFPHPERPGGAIIFTAEEKRPKDSSCRTCCRCGTEYLVSSSGRCIRDEECYYHWGRLRRNRVAGGWETQYMCCSAAAGSVGCQVAKGPNQ

SEQ ID NO: 851412 - protein, 121 aa, Homo sapiens
RARLQGGDMQAIFIISLHNPAVFTRGAAAQESCLTGALCFVVDMKTMETAEKLARFVAQVGPEIEQFSIENSTDNPDLCAWPKIYIFFRDKVLLCHPGAVARACNPSLAGLRQEDRLSPGA

SEQ ID NO: 851413 - protein, 1138 aa, Homo sapiens
AAVRRGAAETVGSFACPRLARRRRRVRSLRRRRGWLRARWSRGQNNMAARRITQETFDAVLQEKAKRYHMDASGEAVSETLQFKAQDLLRAVPRSRAEMYDDVHSDGRYSLSGSVAHSRDAGREGLRSDVFPGPSFRSSNPSISDDSYFRKECGRDLEFSHSDSRDQVIGHRKLGHFRSQDWKFALRGSWEQDFGHPVSQESSWSQEYSFGPSAVLGDFGSSRLIEKECLEKESRDYDVDHPGEADSVLRGSSQVQARGRALNIVDQEGSLLGKGETQGLLTAKGGVGKLVTLRNVSTKKIPTVNRITPKTQGTNQIQKNTPSPDVTLGTNPGTEDIQFPIQKIPLGLDLKNLRLPRRKMSFDIIDKSDVFSRFGIEIIKWAGFHTIKDDIKFSQLFQTLFELETETCAKMLASFKCSLKPEHRDFCFFTIKFLKHSALKTPRVDNEFLNMLLDKGAVKTKNCFFEIIKPFDKYIMRLQDRLLKSVTPLLMACNAYELSVKMKTLSNPLDLALALETTNSLCRKSLALLGQTFSLASSFRQEKILEAVGLQDIAPSPAAFPNFEDSTLFGREYIDHLKAWLVSSGCPLQVKKAEPEPMREEEKMIPPTKPEIQAKAPSSLSDAVPQRADHRVVGTIDQLVKRVIEGSLSPKERTLLKEDPAYWFLSDENSLEYKYYKLKLAEMQRMSENLRGADQKPTSADCAVRAMLYSRAVRNLKKKLLPWQRRGLLRAQGLRGWKARRATTGTQTLLSSGTRLKHHGRQAPGLSQAKPSLPDRNDAAKDCPPDPVGPSPQDPSLEASGPSPKPAGVDISEAPQTSSPCPSADIDMKTMETAEKLARFVAQVGPEIEQFSIENSTDNPDLWFLHDQNSSAFKFYRKKVFELCPSICFTSSPHNLHTGGGDTTGSQESPVDLMEGEAEFEDEPPPREAELESPEVMPEEEDEDDEDGGEEAPAPGGAGKSEGSTPADGLPGEAAEDDLAGAPALSQASSGTCFPRKRISSKSLKVGMIPAPKRVCLIQEPKVHEPVRIAYDRPRGRPMSKKKKPKDLDFAQQKLTDKNLGFQMLQKMGWKEGHGLGSLGKGIREPVSVYAAGSLGWEWVGPQSFHLQPAAWLLHSQDGLQLAVDFCFLNRRHLQMRS

SEQ ID NO: 851414 - protein, 1094 aa, Homo sapiens
AAVRRGAAETVGSFACPRLARRRRRVRSLRRRRGWLRARWSRDLLRAVPRSRAEMYDDVHSDGRYSLSGSVAHSRDAGREGLRSDVFPGPSFRSSNPSISDDSYFRKECGRDLEFSHSDSRDQVIGHRKLGHFRSQDWKFALRGSWEQDFGHPVSQESSWSQEYSFGPSAVLGDFGSSRLIEKECLEKESRDYDVDHPGEADSVLRGSSQVQARGRALNIVDQEGSLLGKGETQGLLTAKGGVGKLVTLRNVSTKKIPTVNRITPKTQGTNQIQKNTPSPDVTLGTNPGTEDIQFPIQKIPLGLDLKNLRLPRRKMSFDIIDKSDVFSRFGIEIIKWAGFHTIKDDIKFSQLFQTLFELETETCAKMLASFKCSLKPEHRDFCFFTIKFLKHSALKTPRVDNEFLNMLLDKGAVKTKNCFFEIIKPFDKYIMRLQDRLLKSVTPLLMACNAYELSVKMKTLSNPLDLALALETTNSLCRKSLALLGQTFSLASSFRQEKILEAVGLQDIAPSPAAFPNFEDSTLFGREYIDHLKAWLVSSGCPLQVKKAEPEPMREEEKMIPPTKPEIQAKAPSSLSDAVPQRADHRVVGTIDQLVKRVIEGSLSPKERTLLKEDPAYWFLSDENSLEYKYYKLKLAEMQRMSENLRGADQKPTSADCAVRAMLYSRAVRNLKKKLLPWQRRGLLRAQGLRGWKARRATTGTQTLLSSGTRLKHHGRQAPGLSQAKPSLPDRNDAAKDCPPDPVGPSPQDPSLEASGPSPKPAGVDISEAPQTSSPCPSADIDMKTMETAEKLARFVAQVGPEIEQFSIENSTDNPDLWFLHDQNSSAFKFYRKKVFELCPSICFTSSPHNLHTGGGDTTGSQESPVDLMEGEAEFEDEPPPREAELESPEVMPEEEDEDDEDGGEEAPAPGGAGKSEGSTPADGLPGEAAEDDLAGAPALSQASSGTCFPRKRISSKSLKVGMIPAPKRVCLIQEPKVHEPVRIAYDRPRGRPMSKKKKPKDLDFAQQKLTDKNLGFQMLQKMGWKEGHGLGSLGKGIREPVSVYAAGSLGWEWVGPQSFHLQPAAWLLHSQDGLQLAVDFCFLNRRHLQMRS

SEQ ID NO: 851415 - protein, 1121 aa, Homo sapiens
SGCAARRCGDRWFICMSPPRAAAAAGQNNMAARRITQETFDAVLQEKAKRYHMDASGEAVSETLQFKAQDLLRAVPRSRAEMYDDVHSDGRYSLSGSVAHSRDAGREGLRSDVFPGPSFRSSNPSISDDSYFRKECGRDLEFSHSDSRDQVIGHRKLGHFRSQDWKFALRGSWEQDFGHPVSQESSWSQEYSFGPSAVLGDFGSSRLIEKECLEKESRDYDVDHPGEADSVLRGSSQVQARGRALNIVDQEGSLLGKGETQGLLTAKGGVGKLVTLRNVSTKKIPTVNRITPKTQGTNQIQKNTPSPDVTLGTNPGTEDIQFPIQKIPLGLDLKNLRLPRRKMSFDIIDKSDVFSRFGIEIIKWAGFHTIKDDIKFSQLFQTLFELETETCAKMLASFKCSLKPEHRDFCFFTIKFLKHSALKTPRVDNEFLNMLLDKGAVKTKNCFFEIIKPFDKYIMRLQDRLLKSVTPLLMACNAYELSVKMKTLSNPLDLALALETTNSLCRKSLALLGQTFSLASSFRQEKILEAVGLQDIAPSPAAFPNFEDSTLFGREYIDHLKAWLVSSGCPLQVKKAEPEPMREEEKMIPPTKPEIQAKAPSSLSDAVPQRADHRVVGTIDQLVKRVIEGSLSPKERTLLKEDPAYWFLSDENSLEYKYYKLKLAEMQRMSENLRGADQKPTSADCAVRAMLYSRAVRNLKKKLLPWQRRGLLRAQGLRGWKARRATTGTQTLLSSGTRLKHHGRQAPGLSQAKPSLPDRNDAAKDCPPDPVGPSPQDPSLEASGPSPKPAGVDISEAPQTSSPCPSADIDMKTMETAEKLARFVAQVGPEIEQFSIENSTDNPDLWFLHDQNSSAFKFYRKKVFELCPSICFTSSPHNLHTGGGDTTGSQESPVDLMEGEAEFEDEPPPREAELESPEVMPEEEDEDDEDGGEEAPAPGGAGKSEGSTPADGLPGEAAEDDLAGAPALSQASSGTCFPRKRISSKSLKVGMIPAPKRVCLIQEPKVHEPVRIAYDRPRGRPMSKKKKPKDLDFAQQKLTDKNLGFQMLQKMGWKEGHGLGSLGKGIREPVSVYAAGSLGWEWVGPQSFHLQPAAWLLHSQDGLQLAVDFCFLNRRHLQMRS

SEQ ID NO: 851416 - protein, 1138 aa, Homo sapiens; identical to SEQ ID NO: 851413

SEQ ID NO: 851417 - protein, 1166 aa, Homo sapiens
AAVRRGAAETVGSFACPRLARRRRRVRSLRRRRGWLRARWSRGQNNMAARRITQETFDAVLQEKAKRYHMDASGEAVSETLQFKAQDLLRAVPRSRAEMYDDVHSDGRYSLSGSVAHSRDAGREGLRSDVFPGPSFRSSNPSISDDSYFRKECGRDLEFSHSDSRDQVIGHRKLGHFRSQDWKFALRGSWEQDFGHPVSQESSWSQEYSFGPSAVLGDFGSSRLIEKECLEKESRDYDVDHPGEADSVLRGSSQVQARGRALNIVDQEGSLLGKGETQGLLTAKGGVGKLVTLRNVSTKKIPTVNRITPKTQGTNQIQKNTPSPDVTLGTNPGTEDIQFPIQKIPLGLDLKNLRLPRRKMSFDIIDKSDVFSRFGIEIIKWAGFHTIKDDIKFSQLFQTLFELETETCAKMLASFKCSLKPEHRDFCFFTIKFLKHSALKTPRVDNEFLNMLLDKGAVKTKNCFFEIIKPFDKYIMRLQDRLLKSVTPLLMACNAYELSVKMKTLSNPLDLALALETTNSLCRKSLALLGQTFSLASSFRQEKILEAVGLQDIAPSPAAFPNFEDSTLFGREYIDHLKAWLVSSGCPLQVKKAEPEPMREEEKMIPPTKPEIQAKAPSSLSDAVPQRADHRVVGTIDQLVKRVIEGSLSPKERTLLKEDPAYWFLSDENSLEYKYYKLKLAEMQRMSENLRGADQKPTSADCAVRAMLYSRAVRNLKKKLLPWQRRGLLRAQGLRGWKARRATTGTQTLLSSGTRLKHHGRQAPGLSQAKPSLPDRNDAAKDCPPDPVGPSPQDPSLEASGPSPKPAGVDISEAPQTSSPCPSADIDMKTMETAEKLARFVAQVGPEIEQFSIENSTDNPDLWFLHDQNSSAFKFYRKKVFELCPSICFTSSPHNLHTGGGDTTGSQESPVDLMEGEAEFEDEPPPREAELESPEVMPEEEDEDDEDGGEEAPAPGGAGKSEGSTPADGLPGEAAEDDLAGAPALSQASSGTCFPRKRISSKSLKVGMIPAPKRVCLIQEPKEARTHQYSRAEACSQNGSLVPLQSPARFSNHVTVFQAPVHEPVRIAYDRPRGRPMSKKKKPKDLDFAQQKLTDKNLGFQMLQKMGWKEGHGLGSLGKGIREPVSVGTPSEGEGLGADGQEHKEDTFDVFRQRMMQMYRHKRANK

SEQ ID NO: 851418 - protein, 1138 aa, Homo sapiens; identical to SEQ ID NO: 851413

SEQ ID NO: 851419 - protein, 779 aa, Homo sapiens
MSFDIIDKSDVFSRFGIEIIKWAGFHTIKDDIKFSQLFQTLFELETETCAKMLASFKCSLKPEHRDFCFFTIKFLKHSALKTPRVDNEFLNMLLDKGAVKTKNCFFEIIKPFDKYIMRLQDRLLKSVTPLLMACNAYELSVKMKTLSNPLDLALALETTNSLCRKSLALLGQTFSLASSFRQEKILEAVGLQDIAPSPAAFPNFEDSTLFGREYIDHLKAWLVSSGCPLQVKKAEPEPMREEEKMIPPTKPEIQAKAPSSLSDAVPQRADHRVVGTIDQLVKRVIEGSLSPKERTLLKEDPAYWFLSDENSLEYKYYKLKLAEMQRMSENLRGADQKPTSADCAVRAMLYSRAVRNLKKKLLPWQRRGLLRAQGLRGWKARRATTGTQTLLSSGTRLKHHGRQAPGLSQAKPSLPDRNDAAKDCPPDPVGPSPQDPSLEASGPSPKPAGVDISEAPQTSSPCPSADIDMKTMETAEKLARFVAQVGPEIEQFSIENSTDNPDLWFLHDQNSSAFKFYRKKVFELCPSICFTSSPHNLHTGGGDTTGSQESPVDLMEGEAEFEDEPPPREAELESPEVMPEEEDEDDEDGGEEAPAPGGAGKSEGSTPADGLPGEAAEDDLAGAPALSQASSGTCFPRKRISSKSLKVGMIPAPKRVCLIQEPKVHEPVRIAYDRPRGRPMSKKKKPKDLDFAQQKLTDKNLGFQMLQKMGWKEGHGLGSLGKGIREPVSVYAAGSLGWEWVGPQSFHLQPAAWLLHSQDGLQLAVDFCFLNRRHLQMRS

SEQ ID NO: 851420 - protein, 1138 aa, Homo sapiens; identical to SEQ ID NO: 851413

SEQ ID NO: 851421 - protein, 292 aa, Homo sapiens
MLRDSIWLPNVFPLCPRFLHDQNSSAFKFYRKKVFELCPSICFTSSPHNLHTGGGDTTGSQESPVDLMEGEAEFEDEPPPREAELESPEVMPEEEDEDDEDGGEEAPAPGGAGKSEGSTPADGLPGEAAEDDLAGAPALSQASSGTCFPRKRISSKSLKVGMIPAPKRVCLIQEPKVHEPVRIAYDRPRGRPMSKKKKPKDLDFAQQKLTDKNLGFQMLQKMGWKEGHGLGSLGKGIREPVSVYAAGSLGWEWVGPQSFHLQPAAWLLHSQDGLQLAVDFCFLNRRHLQMRS

SEQ ID NO: 851422 - protein, 1138 aa, Homo sapiens; identical to SEQ ID NO: 851413

SEQ ID NO: 851423 - protein, 1138 aa, Homo sapiens; identical to SEQ ID NO: 851413

SEQ ID NO: 851424 - protein, 1138 aa, Homo sapiens; identical to SEQ ID NO: 851413

SEQ ID NO: 851425 - protein, 1138 aa, Homo sapiens; identical to SEQ ID NO: 851413

SEQ ID NO: 851426 - protein, 321 aa, Homo sapiens
AAVRRGAAETVGSFACPRLARRRRRVRSLRRRRGWLRARWSRGQNNMAARRITQETFDAVLQEKAKRYHMDASGEAVSETLQFKAQDLLRAVPRSRAEMYDDVHSDGRYSLSGSVAHSRDAGREGLRSDVFPGPSFRSSNPSISDDSYFRKECGRDLEFSHSDSRDQVIGHRKLGHFRSQDWKFALRGSWEQDFGHPVSQESSWSQEYSFGPSAVLGDFGSSRLIEKECLEKESRDYDVDHPGEADSVLRGSSQVQARGRALNIVDQEGSLLGKGETQGDSFHVGHGSGEWMELQAGLSPLTRARRTHLQRGSSALSPASP

SEQ ID NO: 851427 - protein, 709 aa, Homo sapiens
AAVRRGAAETVGSFACPRLARRRRRVRSLRRRRGWLRARWSRGQNNMAARRITQETFDAVLQEKAKRYHMDASGEAVSETLQFKAQDLLRAVPRSRAEMYDDVHSDGRYSLSGSVAHSRDAGREGLRSDVFPGPSFRSSNPSISDDSYFRKECGRDLEFSHSDSRDQVIGHRKLGHFRSQDWKFALRGSWEQDFGHPVSQESSWSQEYSFGPSAVLGDFGSSRLIEKECLEKESRDYDVDHPGEADSVLRGSSQVQARGRALNIVDQEGSLLGKGETQGLLTAKGGVGKLVTLRNVSTKKIPTVNRITPKTQGTNQIQKNTPSPDVTLGTNPGTEDIQFPIQKIPLGLDLKNLRLPRRKMSFDIIDKSDVFSRFGIEIIKWAGFHTIKDDIKFSQLFQTLFELETETCAKMLASFKCSLKPEHRDFCFFTIKFLKHSALKTPRVDNEFLNMLLDKGAVKTKNCFFEIIKPFDKYIMRLQDRLLKSVTPLLMACNAYELSVKMKTLSNPLDLALALETTNSLCRKSLALLGQTFSLASSFRQEKILEAVGLQDIAPSPAAFPNFEDSTLFGREYIDHLKAWLVSSGCPLQVKKAEPEPMREEEKMIPPTKPEIQAKAPSSLSDAVPQRADHRVVGTIDQLVKRVIEGSLSPKERTLLKEDPAYWFLSDENSLEYKYYKLKLAEMPLWVLYCLWLVSITGNHLENCSVFGP

SEQ ID NO: 851428 - protein, 102 aa, Homo sapiens
IDAPYLTMSLCDDPPEKKPKDLDFAQQKLTDKNLGFQMLQKMGWKEGHGLGSLGKGIREPVSVGTPSEGEGLGADGQEHKEDTFDVFRQRMMQMYRHKRANK

SEQ ID NO: 851429 - protein, 1092 aa, Homo sapiens
MAARRITQETFDAVLQEKAKRYHMDASGEAVSETLQFKAQDLLRAVPRSRAEMYDDVHSDGRYSLSGSVAHSRDAGREGLRSDVFPGPSFRSSNPSISDDSYFRKECGRDLEFSHSDSRDQVIGHRKLGHFRSQDWKFALRGSWEQDFGHPVSQESSWSQEYSFGPSAVLGDFGSSRLIEKECLEKESRDYDVDHPGEADSVLRGSSQVQARGRALNIVDQEGSLLGKGETQGLLTAKGGVGKLVTLRNVSTKKIPTVNRITPKTQGTNQIQKNTPSPDVTLGTNPGTEDIQFPIQKIPLGLDLKNLRLPRRKMSFDIIDKSDVFSRFGIEIIKWAGFHTIKDDIKFSQLFQTLFELETETCAKMLASFKCSLKPEHRDFCFFTIKFLKHSALKTPRVDNEFLNMLLDKGAVKTKNCFFEIIKPFDKYIMRLQDRLLKSVTPLLMACNAYELSVKMKTLSNPLDLALALETTNSLCRKSLALLGQTFSLASSFRQEKILEAVGLQDIAPSPAAFPNFEDSTLFGREYIDHLKAWLVSSGCPLQVKKAEPEPMREEEKMIPPTKPEIQAKAPSSLSDAVPQRADHRVVGTIDQLVKRVIEGSLSPKERTLLKEDPAYWFLSDENSLEYKYYKLKLAEMQRMSENLRGADQKPTSADCAVRAMLYSRAVRNLKKKLLPWQRRGLLRAQGLRGWKARRATTGTQTLLSSGTRLKHHGRQAPGLSQAKPSLPDRNDAAKDCPPDPVGPSPQDPSLEASGPSPKPAGVDISEAPQTSSPCPSADIDMKTMETAEKLARFVAQVGPEIEQFSIENSTDNPDLWFLHDQNSSAFKFYRKKVFELCPSICFTSSPHNLHTGGGDTTGSQESPVDLMEGEAEFEDEPPPREAELESPEVMPEEEDEDDEDGGEEAPAPGGAGKSEGSTPADGLPGEAAEDDLAGAPALSQASSGTCFPRKRISSKSLKVGMIPAPKRVCLIQEPKVHEPVRIAYDRPRGRPMSKKKKPKDLDFAQQKLTDKNLGFQMLQKMGWKEGHGLGSLGKGIREPVSVYAAGSLGWEWVGPQSFHLQPAAWLLHSQDGLQLAVDFCFLNRRHLQMRS

SEQ ID NO: 851430 - protein, 1092 aa, Homo sapiens; identical to SEQ ID NO: 851429

SEQ ID NO: 851431 - protein, 1128 aa, Homo sapiens
AAVRRGAAETVGSFACPRLARRRRRVRSLRRRRGWLRARWSRGQNNMAARRITQETFDAVLQEKAKRYHMDASGEAVSETLQFKAQDLLRAVPRSRAEMYDDVHSDGRYSLSGSVAHSRDAGREGLRSDVFPGPSFRSSNPSISDDSYFRKECGRDLEFSHSDSRDQVIGHRKLGHFRSQDWKFALRGSWEQDFGHPVSQESSWSQEYSFGPSAVLGDFGSSRLIEKECLEKESRDYDVDHPGEADSVLRGSSQVQARGRALNIVDQEGSLLGKGETQGLLTAKGGVGKLVTLRNVSTKKIPTVNRITPKTQGTNQIQKNTPSPDVTLGTNPGTEDIQFPIQKIPLGLDLKNLRLPRRKMSFDIIDKSDVFSRFGIEIIKWAGFHTIKDDIKFSQLFQTLFELETETCAKMLASFKCSLKPEHRDFCFFTIKFLKHSALKTPRVDNEFLNMLLDKGAVKTKNCFFEIIKPFDKYIMRLQDRLLKSVTPLLMACNAYELSVKMKTLSNPLDLALALETTNSLCRKSLALLGQTFSLASSFRQEKILEAVGLQDIAPSPAAFPNFEDSTLFGREYIDHLKAWLVSSGCPLQVKKAEPEPMREEEKMIPPTKPEIQAKAPSSLSDAVPQRADHRVVGTIDQLVKRVIEGSLSPKERTLLKEDPAYWFLSDENSLEYKYYKLKLAEMQRMSENLRGADQKPTSADCAVRAMLYSRAVRNLKKKLLPWQRRGLLRAQGLRGWKARRATTGTQTLLSSGTRLKHHGRQAPGLSQAKPSLPDRNDAAKDCPPDPVGPSPQDPSLEASGPSPKPAGVDISEAPQTSSPCPSADIDMKTMETAEKLARFVAQVGPEIEQFSIENSTDNPDLWFLHDQNSSAFKFYRKKVFELCPSICFTSSPHNLHTGGGDTTGSQESPVDLMEGEAEFEDEPPPREAELESPEVMPEEEDEDDEDGGEEAPAPGGAGKSEGSTPADGLPGEAAEDDLAGAPALSQASSGTCFPRKRISSKSLKVGMIPAPKRVCLIQEPKVHEPVRIAYDRPRGRPMSKKKKPKDLDFAQQKLTDKNLGFQMLQKMGWKEGHGLGSLGKGIREPVSVGTPSEGEGLGADGQEHKEDTFDVFRQRMMQMYRHKRANK

SEQ ID NO: 851432 - protein, 1138 aa, Homo sapiens; identical to SEQ ID NO: 851413

SEQ ID NO: 851433 - protein, 1138 aa, Homo sapiens; identical to SEQ ID NO: 851413

SEQ ID NO: 851434 - protein, 386 aa, Homo sapiens
NLGPQQLKELYLAGRQLLRFSPAGNDAAKDCPPDPVGPSPQDPSLEASGPSPKPAGVDISEAPQTSSPCPSADIDMKTMETAEKLARFVAQVGPEIEQFSIENSTDNPDLWFLHDQNSSAFKFYRKKVFELCPSICFTSSPHNLHTGGGDTTGSQESPVDLMEGEAEFEDEPPPREAELESPEVMPEEEDEDDEDGGEEAPAPGGAGKSEGSTPADGLPGEAAEDDLAGAPALSQASSGTCFPRKRISSKSLKVGMIPAPKRVCLIQEPKVHEPVRIAYDRPRGRPMSKKKKPKDLDFAQQKLTDKNLGFQMLQKMGWKEGHGLGSLGKGIREPVSVYAAGSLGWEWVGPQSFHLQPAAWLLHSQDGLQLAVDFCFLNRRHLQMRS

SEQ ID NO: 851435 - protein, 1128 aa, Homo sapiens; identical to SEQ ID NO: 851431

SEQ ID NO: 851436 - protein, 1128 aa, Homo sapiens; identical to SEQ ID NO: 851431

SEQ ID NO: 851437 - protein, 1138 aa, Homo sapiens; identical to SEQ ID NO: 851413

SEQ ID NO: 851438 - protein, 1053 aa, Homo sapiens
AAVRRGAAETVGSFACPRLARRRRRVRSLRRRRGWLRARWSRGQNNMAARRITQETFDAVLQEKAKRYHMDASGEAVSETLQFKAQDLLRAVPRSRAEMYDDVHSDGRYSLSGSVAHSRDAGREGLRSDVFPGPSFRSSNPSISDDSYFRKECGRDLEFSHSDSRDQVIGHRKLGHFRSQDWKFALRGSWEQDFGHPVSQESSWSQEYSFGPSAVLGDFGSSRLIEKECLEKESRDYDVDHPGEADSVLRGSSQVQARGRALNIVDQEGSLLGKGETQGLLTAKGGVGKLVTLRNVSTKKIPTVNRITPKTQGTNQIQKNTPSPDVTLGTNPGTEDIQFPIQKIPLGLDLKNLRLPRRKMSFDIIDKSDVFSRFGIEIIKWAGFHTIKDDIKFSQLFQTLFELETETCAKMLASFKCSLKPEHRDFCFFTIKFLKHSALKTPRVDNEFLNMLLDKGAVKTKNCFFEIIKPFDKYIMRLQDRLLKSVTPLLMACNAYELSVKMKTLSNPLDLALALETTNSLCRKSLALLGQTFSLASSFRQEKILEAVGLQDIAPSPAAFPNFEDSTLFGREYIDHLKAWLVSSGCPLQVKKAEPEPMREEEKMIPPTKPEIQAKAPSSLSDAVPQRADHRVVGTIDQLVKRVIEGSLSPKERTLLKEDPAYWFLSDENSLEYKYYKLKLAEMQRMSENLRGADQKPTSADCAVRAMLYSRAVRNLKKKLLPWQRRGLLRAQGLRGWKARRATTGTQTLLSSGTRLKHHGRQAPGLSQAKPSLPDRNDAAKDCPPDPVGPSPQDPSLEASGPSPKPAGVDISEAPQTSSPCPSADIDMKTMETAEKLARFVAQVGPEIEQFSIENSTDNPDLWFLHDQNSSAFKFYRKKVFELCPSICFTSSPHNLHTGGGDTTGSQESPVDLMEGEAEFEDEPPPREAELESPEVMPEEEDEDDEDGGEEAPAPGGAGKSEGSTPADGLPGEAAEDDLAGAPALSQASSGTCFPRKRISSKSLKVGMIPAPKRVCLIQEPKEARTHQYSRAEACSQNGSLVPLQSPARFSNH

SEQ ID NO: 851439 - protein, 253 aa, Homo sapiens
MAAARATTPADGEEPAPEAEALAAARERSSRFLSGLELVKQGAEARVFRGRFQGRAAVIKHRFPKGYRHPALEARLGRRRTVQEARALLRCRRAGISAPVVFFVDYASNCLYMEEIEGSVTVRDYIQSTMETEKTPQGLSNLAKTIGQVLARMHDEDLIHGDLTTSNMLLKPPLEQLNIVLIDFGLSFISALPEDKGVDLYVLEKAFLSTHPNTETVFEAFLKSYSTSSKKARPVLKKLDEVRLRGRKRSMVG

SEQ ID NO: 851440 - protein, 253 aa, Homo sapiens; identical to SEQ ID NO: 851439

SEQ ID NO: 851441 - protein, 191 aa, Homo sapiens
NRSYENRCPLLAAASVVELVQEARALLRCRRAGISAPVVFFVDYASNCLYMEEIEGSVTVRDYIQSTMETEKTPQGLSNLAKTIGQVLARMHDEDLIHGDLTTSNMLLKPPLEQLNIVLIDFGLSFISALPEDKGVDLYVLEKAFLSTHPNTETVFEAFLKSYSTSSKKARPVLKKLDEVRLRGRKRSMVG

SEQ ID NO: 851442 - protein, 253 aa, Homo sapiens; identical to SEQ ID NO: 851439

SEQ ID NO: 851443 - protein, 253 aa, Homo sapiens; identical to SEQ ID NO: 851439

SEQ ID NO: 851444 - protein, 235 aa, Homo sapiens
MAAARATTPADGEEPAPEAEALAAARERSSRFLSGLELVKQGAEARVFRGRFQGRAAVIKHRFPKGYRHPALEARLGRRRTVQEARALLRCRRAGISAPVVFFVDYASNCLYMEEIEGSVTVRDYIQSTMETERMHDEDLIHGDLTTSNMLLKPPLEQLNIVLIDFGLSFISALPEDKGVDLYVLEKAFLSTHPNTETVFEAFLKSYSTSSKKARPVLKKLDEVRLRGRKRSMVG

SEQ ID NO: 851445 - protein, 277 aa, Homo sapiens
MSSCSRVALVTGANRGIGLAIARELCRQFSGDVVLTARDVARGQAAVQQLQAEGLSPRFHQLDIDDLQSIRALRDFLRKEYGGLNVLVNNAAVAFKSDDPMPFDIKAEMTLKTNFFATRNMCNELLPIMKPHGRVVNISSLQCLRAFENCSEDLQERFHSETLTEGDLVDLMKKFVEDTKNEVHEREGWPNSPYGVSKLGVTVLSRILARRLDEKRKADRILVNACCPGPVKTDMDGKDSIRTVEEGAETPVYLALLPPDATEPQGQLVHDKVVQNW

SEQ ID NO: 851446 - protein, 277 aa, Homo sapiens; identical to SEQ ID NO: 851445

SEQ ID NO: 851447 - protein, 147 aa, Homo sapiens
MSSCSRVALVTGANRGIGLAIARELCRQFSGDVVLTARDVARGQAAVQQLQAEGLSPRFHQLDIDDLQSIRALRDFLRKEYGGLNVLVNNAAVAFKSDDPMPFDIKAEMTLKTNFFATRNMCNELLPIMKPHGKPNVWTVGLHPSVR

SEQ ID NO: 851448 - protein, 918 aa, Homo sapiens
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQATHPVMDLKAFPKDNMLWVEWTTPRESVKKYILEWCVLSDKAPCITDWQQEDGTVHRTYLRGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 851449 - protein, 890 aa, Homo sapiens
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDNIASFEANGKILDYEVTLTRWKSHLQNYTVNATKLTVNLTNDRYLATLTVRNLVGKSDAAVLTIPACDFQATHPVMDLKAFPKDNMLWVEWTTPRESVKKYILEWCVLSDKAPCITDWQQEDGTVHRTYLRGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 851450 - protein, 872 aa, Homo sapiens
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMRKMVRDTGVTGVKKQVGSPMKITLPPFEANGKILDYEVTLTRWKSHLQNYTVNATKLTVNLTNDRYLATLTVRNLVGKSDAAVLTIPACDFQATHPVMDLKAFPKDNMLWVEWTTPRESVKKYILEWCVLSDKAPCITDWQQEDGTVHRTYLRGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 851451 - protein, 617 aa, Homo sapiens
MKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQATHPVMDLKAFPKDNMLWVEWTTPRESVKKYILEWCVLSDKAPCITDWQQEDGTVHRTYLRGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 851452 - protein, 946 aa, Homo sapiens
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQATHPVMDLKAFPKDNMLWVEWTTPRESVKKYILEWCVLSDKAPCITDWQQEDGTVHRTYLRGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFVSWIHYGFFTWLESCQRGPYSLVEEILQTQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 851453 - protein, 237 aa, Homo sapiens [sequence omitted]

SEQ ID NO: 851454 - protein, 918 aa, Homo sapiens; identical to SEQ ID NO: 851448

SEQ ID NO: 851455 - protein, 918 aa, Homo sapiens; identical to SEQ ID NO: 851448

SEQ ID NO: 851456 - protein, 918 aa, Homo sapiens; identical to SEQ ID NO: 851448

SEQ ID NO: 851457 - protein, 890 aa, Homo sapiens
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMRKMVRDTGVTGVKKQVGSPMKITLPPFEANGKILDYEVTLTRWKSHLQNYTVNATKLTVNLTNDRYLATLTVRNLVGKSDAAVLTIPACDFQATHPVMDLKAFPKDNMLWVEWTTPRESVKKYILEWCVLSDKAPCITDWQQEDGTVHRTYLRGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 851458 - protein, 918 aa, Homo sapiens; identical to SEQ ID NO: 851448

SEQ ID NO: 851459 - protein, 736 aa, Homo sapiens
INDSLHLVSNFKILDSSELITDKLCGGLGFNFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQATHPVMDLKAFPKDNMLWVEWTTPRESVKKYILEWCVLSDKAPCITDWQQEDGTVHRTYLRGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 851460 - protein, 918 aa, Homo sapiens; identical to SEQ ID NO: 851448

SEQ ID NO: 851461 - protein, 918 aa, Homo sapiens; identical to SEQ ID NO: 851448

SEQ ID NO: 851462 - protein, 918 aa, Homo sapiens; identical to SEQ ID NO: 851448

SEQ ID NO: 851463 - protein, 918 aa, Homo sapiens; identical to SEQ ID NO: 851448

SEQ ID NO: 851464 - protein, 241 aa, Homo sapiens
MAPVRRSAKWRPGGIEARGEGVSTVGYRNKNVRQKTWRPNHPQAFVGSVREGQGFAFRRKLKIQQSYKKLLRKEKKAQTSLESQFTDRYPDNLKHLYLAEEERHRKQARKVDHPLSEQVHQPLLEEQCSIDEPLFEDQCSFDQPQPEEQCIKTVNSFTIPKKNKKKTSNQKAQEEYEQIQAKRAAKKQEFERRKQEREEAQRQYKKKKMEVFKILNKKTKKGQPNLNVQMEYLLQKIQEKC

SEQ ID NO: 851465 - protein, 164 aa, Homo sapiens
MAPVRRSAKWRPGGIEARGEGVSTVGYRNKNVRQKTWRPNHPQAFVGSVREGQGFAFRRKLKIQQSYKKLLRKEKKAQTSLESQFTDRYPDNLKHLYLAEEERHRKQARKVDHPLSEQVHQPLLEEQCSIDEPLFEDQCSFDQPQPEEQCIKTVKYVFSSFEIL

SEQ ID NO: 851466 - protein, 208 aa, Homo sapiens
MAPVRRSAKWRPGGIEARGEGVSTVGYRNKNVRQKTWRPNHPQAFVGSVREGQGFAFRRKLKIQQSYKKLLRKEKKAQTSLESQFTDRYPDNLKHLYLAEEERHRKQARKVDHPLSEQVHQPLLEEQCSIDEPLFEDQCSFDQPQPEEQCIKTVNSFTIPKKNKKKTSNQKAQEEYEQIQAKRAAKKQIRVFKAGPSRLDTAQRNKSK

SEQ ID NO: 851467 - protein, 241 aa, Homo sapiens; identical to SEQ ID NO: 851464

SEQ ID NO: 851468 - protein, 241 aa, Homo sapiens; identical to SEQ ID NO: 851464

SEQ ID NO: 851469 - protein, 404 aa, Homo sapiens
MVGKTFTYLLGSDAAALLFNSKNEDLNAEDVYSRLTTPVFGKGVAYDVPNPVFLEQKKMLKSGLNIAHFKQHVSIIEKETKEYFESWGESGEKNVFEALSELIILTASHCLHGKEIRSQLNEKVAQLYADLDGGFSHAAWLLPGWLPLPSFRRRDRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKDLNLLDRCIKETLRLRPPIMIMMRMARTPQTVAGYTIPPGHQVCVSPTVNQRLKDSWVERLDFNPDRYLQDNPASGEKFAYVPFGAGRHRCIGENFAYVQIKTIWSTMLRLYEFDLIDGYFPTVNYTTMIHTPENPVIRYKRRSK

SEQ ID NO: 851470 - protein, 346 aa, Homo sapiens
MLKSGLNIAHFKQHVSIIEKETKEYFESWGESGEKNVFEALSELIILTASHCLHGKEIRSQLNEKVAQLYADLDGGFSHAAWLLPGWLPLPSFRRRDRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKDLNLLDRCIKETLRLRPPIMIMMRMARTPQTVAGYTIPPGHQVCVSPTVNQRLKDSWVERLDFNPDRYLQDNPASGEKFAYVPFGAGRHRCIGENFAYVQIKTIWSTMLRLYEFDLIDGYFPTVNYTTMIHTPENPVIRYKRRSK

SEQ ID NO: 851471 - protein, 127 aa, Homo sapiens
DSRVSPGKNHTQTVAGYTIPPGHQVCVSPTVNQRLKDSWVERLDFNPDRYLQDNPASGEKFAYVPFGAGRHRCIGENFAYVQIKTIWSTMLRLYEFDLIDGYFPTVNYTTMIHTPENPVIRYKRRSK

SEQ ID NO: 851472 - protein, 509 aa, Homo sapiens
MAAAAGMLLLGLLQAGGSVLGQAMEKVTGGNLLSMLLIACAFTLSLVYLIRLAAGHLVQLPAGVKSPPYIFSPIPFLGHAIAFGKSPIEFLENAYEKYGPVFSFTMVGKTFTYLLGSDAAALLFNSKNEDLNAEDVYSRLTTPVFGKGVAYDVPNPVFLEQKKMLKSGLNIAHFKQHVSIIEKETKEYFESWGESGEKNVFEALSELIILTASHCLHGKEIRSQLNEKVAQLYADLDGGFSHAAWLLPGWLPLPSFRRRDRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKDLNLLDRCIKETLRLRPPIMIMMRMARTPQTVAGYTIPPGHQVCVSPTVNQRLKDSWVERLDFNPDRYLQDNPASGEKFAYVPFGAGRHRCIGENFAYVQIKTIWSTMLRLYEFDLIDGYFPTVNYTTMIHTPENPVIRYKRRSK

SEQ ID NO: 851473 - protein, 509 aa, Homo sapiens; identical to SEQ ID NO: 851472

SEQ ID NO: 851474 - protein, 489 aa, Homo sapiens
MAAAAGMLLLGLLQAGGSVLGQAMEKVTGGNLLSMLLIACAFTLSLVYLIRLAAGHLVQLPAGVKSPPYIFSPIPFLGHAIAFGKSPIEFLENAYEKYGPVFSFTMVGKTFTYLLGSDAAALLFNSKNEDLNAEDVYSRLTTPVFGKGVAYDVPNPVFLEQKKMLKSGLNIAHFKQHVSIIEKETKEYFESWGESGEKNVFEALSELIILTASHCLHGKEIRSQLNVALTSLLAPGSRRDRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKDLNLLDRCIKETLRLRPPIMIMMRMARTPQTVAGYTIPPGHQVCVSPTVNQRLKDSWVERLDFNPDRYLQDNPASGEKFAYVPFGAGRHRCIGENFAYVQIKTIWSTMLRLYEFDLIDGYFPTVNYTTMIHTPENPVIRYKRRSK

SEQ ID NO: 851475 - protein, 481 aa, Homo sapiens
MAAAAGMLLLGLLQAGGSVLGQAMEKVTGGNLLSMLLIACAFTLSLVYLIRLAAGHLVQLPAGVKSPPYIFSPIPFLGHAIAFGKSPIEFLENAYEKYGPVFSFTMVGKTFTYLLGSDAAALLFNSKNEDLNAEDVYSRLTTPVFGKGVAYDVPNPVFLEQKKMLKSGLNIAHFKQHVSIIEKETKEYFESWGESGEKNVFEALSELIILTASHCLHGKEIRSQLNEKVAQLYADLDGGFSHAAWLLPGWLPLPSFRRRDRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKDLNLLDRCIKETLRLRPPIMIMMRMARTPQTVAGYTIPPGHQDNPASGEKFAYVPFGAGRHRCIGENFAYVQIKTIWSTMLRLYEFDLIDGYFPTVNYTTMIHTPENPVIRYKRRSK

SEQ ID NO: 851476 - protein, 306 aa, Homo sapiens
MAAAAGMLLLGLLQAGGSVLGQAMEKVTGGNLLSMLLIACAFTLSLVYLIRLAAGHLVQLPAGVKSPPYIFSPIPFLGHAIAFGKSPIEFLENAYEKYGPVFSFTMVGKTFTYLLGSDAAALLFNSKNEDLNAEDVYSRLTTPVFGKGVAYDVPNPVFLEQKKMLKSGLNIAHFKQHVSIIEKETKEYFESWGESGEKNVFEALSELIILTASHCLHGKEIRSQLNEKVAQLYADLDGGFSHAAWLLPGWLPLPSFRRRDRAHREIKDIFYKAIQKRRQSQEKIDDILQTLLDATYKDGRPLTDDE

SEQ ID NO: 851477 - protein, 385 aa, Homo sapiens
MAAAAGMLLLGLLQAGGSVLGQAMEKVTGGNLLSMLLIACAFTLSLVYLIRLAAGHLVQLPAGVKSPPYIFSPIPFLGHAIAFGKSPIEFLENAYEKYGPVFSFTMVGKTFTYLLGSDAAALLFNSKNEDLNAEDVYSRLTTPVFGKGVAYDVPNPVFLEQKKMLKSGLNIAHFKQHVSIIEKETKEYFESWGESGEKNVFEALSELIILTASHCLHGKEIRSQLNEKVAQLYADLDGGFSHAAWLLPGWLPLPSFRRRDRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKDLNLLDRCITPQTVAGYTIPP

SEQ ID NO: 851478 - protein, 666 aa, Homo sapiens
MADMEDLFGSDADSEAERKDSDSGSDSDSDQENAASGSNASGSESDQDERGDSGQPSNKELFGDDSEDEGASHHSGSDNHSERSDNRSEASERSDHEDNDPSDVDQHSGSEAPNDDEDEGHRSDGGSHHSEAEGSEKAHSDDEKWGREDKSDQSDDEKIQNSDDEERAQGSDEDKLQNSDDDEKMQNTDDEERPQLSDDERQQLSEEEKANSDDERPVASDNDDEKQNSDDEEQPQLSDEEKMQNSDDERPQASDEEHRHSDDEEEQDHKSESARGSDSEDEVLRMKRKNAIASDSEADSDTEVPKDNSGTMDLFGGADDISSGSDGEDKPPTPGQPVDENGLPQDQQEEEPIPETRIEVEIPKVNTDLGNDLYFVKLPNFLSVEPRPFDPQYYEDEFEDEEMLDEEGRTRLKLKVENTIRWRIRRDEEGNEIKESNARIVKWSDGSMSLHLGNEVFDVYKAPLQGDHNHLFIRQGTGLQGQAVFKTKLTFRPHSTDSATHRKMTLSLADRCSKTQKIRILPMAGRDPECQRTEMIKKEEERLRASIRRESQQRRMREKQHQRGLSASYLEPDRYDEEEEGEESISLAAIKNRYKGGIREERARIYSSDSDEGSEEDKAQRLLKAKKLTSDEEGEPSGKRKAEDDDKANKKHKKYVISDEEEEDDD

SEQ ID NO: 851479 - protein, 364 aa, Homo sapiens [sequence omitted]

SEQ ID NO: 851480 - protein, 368 aa, Homo sapiens [sequence omitted]

SEQ ID NO: 851481 - protein, 364 aa, Homo sapiens
VFFICGLWPFIIRILHFLFIRQLWLFFIIRILCLIIIIRSYRPFIIRIKPIPETRIEVEIPKVNTDLGNDLYFVKLPNFLSVEPRPFDPQYYEDEFEDEEMLDEEGRTRLKLKVENTIRWRIRRDEEGNEIKESNARIVKWSDGSMSLHLGNEVFDVYKAPLQGDHNHLFIRQGTGLQGQAVFKTKLTFRPHSTDSATHRKMTLSLADRCSKTQKIRILPMAGRDPECQRTEMIKKEEERLRASIRRESQQRRMREKQHQRGLSASYLEPDRYDEEEEGEESISLAAIKNRYKGGIREERARIYSSDSDEGSEEDKAQRLLKAKKLTSDEEGEPSGKRKAEDDDKANKKHKKYVISDEEEEDDD

SEQ ID NO: 851482 - protein, 745 aa, Homo sapiens
MADMEDLFGSDADSEAERKDSDSGSDSDSDQENAASGSNASGSESDQDERGDSGQPSNKELFGDDSEDEGASHHSGSDNHSERSDNRSEASERSDHEDNDPSDVDQHSGSEAPNDDEDEGHRSDGGSHHSEAEGSEKAHSDDEKWGREDKSDQSDDEKIQNSDDEERAQGSDEDKLQNSDDDEKMQNTDDEERPQLSDDERQQLSEEEKANSDDERPVASDNDDEKQNSDDEEQPQLSDEEKMQNSDDERPQASDEEHRHSDDEEEQDHKSESARGSDSEDEVLRMKRKNAIASDSEADSDTEVPKDNSGTMDLFGGADDISSGSDGEDKPPTPGQPVDENGLPQDQQEEEPIPETRIEVEIPKVNTDLGNDLYFVKLPNFLSVEPRPFDPQYYEDEFEDEEMLDEEGRTRLKLKVENTIRWRIRRDEEGNEIKESNARIVKWSDGSMSLHLGNEVFDVYKAPLQGDHNHLFIRQGTGLQGQAVFKTKLTFRPHSTDSATHRKMTLSLADRCSKTQKIRILPMAGRDPECQRTEMIKKEEERLRASIRRESQQRRMREKQHQRGLSASYLEPDRYDEEEEGEESISLAAIKNRYKGGIREERARIYSSDSDEGSEEDKAQRLLKAKKLTSDEEGDLPEEKRRDADTHIQAYEVCDHKQTKQTKTRRAAWQRSIRPPVGRAHRMPVQRVPRPRDQVGPQKTRDRGTHVTSQGNKQPEKATVERTTYQTSQNRDTIGKKKEITDTPT

SEQ ID NO: 851483 - protein, 332 aa, Homo sapiens
MLAVHFDKPGGPENLYVKEVAKPSPGEGEVLLKVAASALNRADLMQRQGQYDPPPGASNILGLEASGHVAELGPGCQGHWKIGDTAMALLPGGGQAQYVTVPEGLLMPIPEGLTLTQAAAIPEAWLTAFQLLHLVGNVQAGDYVLIHAGLSGVGTAAIQLTRMAGAIPLVTAGSQKKLQMAEKLGAAAGFNYKKEDFSEATLKFTKGAGVNLILDCIGGSYWEKNVNCLALDGRWVLYGLMGGGDINGPLFSKLLFKRGSLITSLLRSRDNKYKQMLVNAFTEQILPHFSTEGPQRLLPVLDRIYPVTEIQEAHKYMEANKNIGKIVLELPQ

SEQ ID NO: 851484 - protein, 332 aa, Homo sapiens; identical to SEQ ID NO: 851483

SEQ ID NO: 851485 - protein, 332 aa, Homo sapiens; identical to SEQ ID NO: 851483

SEQ ID NO: 851486 - protein, 319 aa, Homo sapiens
MLAVHFDKPGGPENLYVKEVAKPSPGEGEVLLKVAASALNRADLMQRQGQYDPPPGASNILGLEASGHVAELGPGCQGHWKIGDTAMALLPGGGQAQYVTVPEGLLMPIPEGLTLTQAAAIPEAWLTAFQLLHLVGLSGVGTAAIQLTRMAGAIPLVTAGSQKKLQMAEKLGAAAGFNYKKEDFSEATLKFTKGAGVNLILDCIGGSYWEKNVNCLALDGRWVLYGLMGGGDINGPLFSKLLFKRGSLITSLLRSRDNKYKQMLVNAFTEQILPHFSTEGPQRLLPVLDRIYPVTEIQEAHKYMEANKNIGKIVLELPQ

SEQ ID NO: 851487 - protein, 248 aa, Homo sapiens
MLAVHFDKPGGPENLYVKEVAKPSPGEGEVLLKVAASALNRADLMQRQGQYDPPPGASNILGLEASGHVAELGPGCQGHWKIGDTAMALLPGGGQAQYVTVPEGLLMPIPEGLTLTQAAAIPEAWLTAFQLLHLVGNVQAGDYVLIHAGLSGVGTAAIQLTRMAGAIPLVTAGSQKKLQMAEKLGAAAGFNYKKEDFSEATLKFTKVQANAGECFHGANSASLLHGGPPTSAAGSGQNLPSDRNPGGP

SEQ ID NO: 851488 - protein, 221 aa, Homo sapiens [sequence omitted]

SEQ ID NO: 851489 - protein, 332 aa, Homo sapiens; identical to SEQ ID NO: 851483

SEQ ID NO: 851490 - protein, 410 aa, Homo sapiens
MCQKPGHAWKMDQSARQEVGSRSLERRKFPLLEVQPSIPVEAEAVLGLWGSGFVTGTRRSQNHSAPPGAWEGSRARNNMLAVHFDKPGGPENLYVKEVAKPSPGEGEVLLKVAASALNRADLMQRQGQYDPPPGASNILGLEASGHVAELGPGCQGHWKIGDTAMALLPGGGQAQYVTVPEGLLMPIPEGLTLTQAAAIPEAWLTAFQLLHLVGNVQAGDYVLIHAGLSGVGTAAIQLTRMAGAIPLVTAGSQKKLQMAEKLGAAAGFNYKKEDFSEATLKFTKGAGVNLILDCIGGSYWEKNVNCLALDGRWVLYGLMGGGDINGPLFSKLLFKRGSLITSLLRSRDNKYKQMLVNAFTEQILPHFSTEGPQRLLPVLDRIYPVTEIQEAHKYMEANKNIGKIVLELPQ

SEQ ID NO: 851491 - protein, 261 aa, Homo sapiens
MLAVHFDKPGGPENLYVKEVAKPSPGEGEVLLKVAASALNRADLMQRQGQYDPPPGASNILGLEASGHVAELGPGCQGHWKIGDTAMALLPGGGQAQYVTVPEGLLMPIPEGLTLTQAAAIPEAWLTAFQLLHLVGAGVNLILDCIGGSYWEKNVNCLALDGRWVLYGLMGGGDINGPLFSKLLFKRGSLITSLLRSRDNKYKQMLVNAFTEQILPHFSTEGPQRLLPVLDRIYPVTEIQEAHKYMEANKNIGKIVLELPQ

SEQ ID NO: 851492 - protein, 221 aa, Homo sapiens [sequence omitted]

SEQ ID NO: 851493 - protein, 45 aa, Homo sapiens
MLVNAFTEQILPHFSTEGPQRLLPVLDRIYPVTEIQEAHKYMEAN

SEQ ID NO: 851494 - protein, 704 aa, Homo sapiens
MESKPSRIPRRISVQPSSSLSARMMSGSRGSSLNDTYHSRDSSFRLDSEYQSTSASASASPFQSAWYSESEITQGARSRSQNQQRDHDSKRPKLSCTNCTTSAGRNVGNGLNTLSDSSWRHSQVPRSSSMVLGSFGTDLMRERRDLERRTDSSISNLMDYSHRSGDFTTSSYVQDRVPSYSQGARPKENSMSTLQLNTSSTNHQLPSEHQTILSSRDSRNSLRSNFSSRESESSRSNTQPGFSYSSSRDEAPIISNSERVVSSQRPFQESSDNEGRRTTRRLLSRIASSMSSTFFSRRSSQDSLNTRSLNSENSYVSPRILTASQSRSNVPSASEVPDNRASEASQGFRFLRRRWGLSSLSHNHSSESDSENFNQESEGRNTGPWLSSSLRNRCTPLFSRRRREGRDESSRIPTSDTSSRSHIFRRESNEVVHLEAQNDPLGAAANRPQASAASSSATTGGSTSDSAQGGRNTGISGILPGSLFRFAVPPALGSNLTDNVMITVDIIPSGWNSADGKSDKTKSAPSRDPERLQKIKESLLLEDSEEEEGDLCRICQMAAASSSNLLIEPCKCTGSLQYVHQDCMKKWLQAKINSGSSLEAVTTCELCKEKLELNLEDFDIHELHRAHANEQAEYEFISSGLYLVVLLHLCEQSFSDMMGNTNEPSTRVRFINLARTLQAHMEDLETSEDDSEEDGDHNRTFDIA

SEQ ID NO: 851495 - protein, 704 aa, Homo sapiens; identical to SEQ ID NO: 851494

SEQ ID NO: 851496 - protein, 777 aa, Homo sapiens
AKWGEEEQGGALNGGGWFCAGSGRGAGAIVLRCRLHFLSHGPRTPRRKAAVRVAASGTRTGRCRLRSREKSLRMESKPSRIPRRISVQPSSSLSARMMSGSRGSSLNDTYHSRDSSFRLDSEYQSTSASASASPFQSAWYSESEITQGARSRSQNQQRDHDSKRPKLSCTNCTTSAGRNVGNGLNTLSDSSWRHSQVPRSSSMVLGSFGTDLMRERRDLERRTDSSISNLMDYSHRSGDFTTSSYVQDRVPSYSQGARPKENSMSTLQLNTSSTNHQLPSEHQTILSSRDSRNSLRSNFSSRESESSRSNTQPGFSYSSSRDEAPIISNSERVVSSQRPFQESSDNEGRRTTRRLLSRIASSMSSTFFSRRSSQDSLNTRSLNSENSYVSPRILTASQSRSNVPSASEVPDNRASEASQGFRFLRRRWGLSSLSHNHSSESDSENFNQESEGRNTGPWLSSSLRNRCTPLFSRRRREGRDESSRIPTSDTSSRSHIFRRESNEVVHLEAQNDPLGAAANRPQASAASSSATTGGSTSDSAQGGRNTGISGILPGSLFRFAVPPALGSNLTDNVMITVDIIPSGWNSADGKSDKTKSAPSRDPERLQKIKESLLLEDSEEEEGDLCRICQMAAASSSNLLIEPCKCTGSLQYVHQDCMKKWLQAKINSGSSLEAVTTCELCKEKLELNLEDFDIHELHRAHANEQAEYEFISSGLYLVVLLHLCEQSFSDMMGNTNEPSTRVRFINLARTLQAHMEDLETSEDDSEEDGDHNRTFDIA

SEQ ID NO: 851497 - protein, 204 aa, Homo sapiens
MAKVQVNNVVVLDNPSPFYNPFQFEITFECIEDLSEDLEWKIIYVGSAESEEYDQVLDSVLVGPVPAGRHMFVFQADAPNPGLIPDADAVGVTVVLITCTYRGQEFIRVGYYVNNEYTETELRENPPVKPDFSKLQRNILASNPRVTRFHINWEDNTEKLEDAESSNPNLQSLLSTDALPSASKGWSTSENSLNVMLESHMDCM

SEQ ID NO: 851498 - protein, 204 aa, Homo sapiens; identical to SEQ ID NO: 851497

SEQ ID NO: 851499 - protein, 204 aa, Homo sapiens; identical to SEQ ID NO: 851497

SEQ ID NO: 851500 - protein, 195 aa, Homo sapiens
MAKVQVNNVVVLDNPSPFYNPFQFEITFECIEDLSEDLEWKIIYVGSAESEEYDQVLDSVLVGPVPAGRHMFVFQADAPNPGLIPDADAVGVTVVLITCTYRGQEFIRVGYYVNNEYTETELRENPPVKPDFSKLQRNILASNPRVTRFHINWEDNTECITFSIKGMVHIRKLTKCHVRIPHGLHVTTYHPFSTN

SEQ ID NO: 851501 - protein, 1270 aa, Homo sapiens
RARGSRNSVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRTASPQQREMMDQAAAQLAQDNCELACCFIQKTAVEKAGPEMDKRLATEFELRKHARQEGRRYCDPVVLTYQAERMPEQIRLKVGGVDPKQLAVYEEFARNVPGFLPTNDLSQPTGFLAQPMKQAWATDDVAQIYDKCITELEQHLHAIPPTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKVDMLSEINIAPRILTNFTGVMPPQFKKDLDSYLKTRSPVTFLSDLRSNLQVSNEPGNRYNLQLINALVLYVGTQAIAHIHNKGSTPSMSTITHSAHMDIFQNLAVDLDTEGRYLFLNAIANQLRYPNSHTHYFSCTMLYLFAEANTEAIQEQITRVLLERLIVNRPHPWGLLITFIELIKNPAFKFWNHEFVHCAPEIEKLFQSVAQCCMGQKQAQQVMEGTGAS

SEQ ID NO: 851502 - protein, 1729 aa, Homo sapiens
GAVGCLQACAVSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQTDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRTASPQQREMMDQAAAQLAQDNCELACCFIQKTAVEKAGPEMDKRLATEFELRKHARQEGRRYCDPVVLTYQAERMPEQIRLKVGGVDPKQLAVYEEFARNVPGFLPTNDLSQPTGFLAQPMKQAWATDDVAQIYDKCITELEQHLHAIPPTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQVELLERKMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKVDMLSEINIAPRILTNFTGVMPPQFKKDLDSYLKTRSPVTFLSDLRSNLQVSNEPGNRYNLQLINALVLYVGTQAIAHIHNKGSTPSMSTITHSAHMDIFQNLAVDLDTEGRYLFLNAIANQLRYPNSHTHYFSCTMLYLFAEANTEAIQEQITRVLLERLIVNRPHPWGLLITFIELIKNPAFKFWNHEFVHCAPEIEKLFQSVAQCCMGQKQAQQVMEGTGAS

SEQ ID NO: 851503 - protein, 1722 aa, Homo sapiens
GAVGCLQACAVSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQTDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRTASPQQREMMDQAAAQLAQDNCELACCFIQKTAVEKAGPEMDKRLATEFELRKHARQEGRRYCDPVVLTYQAERMPEQIRLKVGGVDPKQLAVYEEFARNVPGFLPTNDLSQPTGFLAQPMKQAWATDDVAQIYDKCITELEQHLHAIPPTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKVDMLSEINIAPRILTNFTGVMPPQFKKDLDSYLKTRSPVTFLSDLRSNLQVSNEPGNRYNLQLINALVLYVGTQAIAHIHNKGSTPSMSTITHSAHMDIFQNLAVDLDTEGRYLFLNAIANQLRYPNSHTHYFSCTMLYLFAEANTEAIQEQITRVLLERLIVNRPHPWGLLITFIELIKNPAFKFWNHEFVHCAPEIEKLFQSVAQCCMGQKQAQQVMEGTGAS

SEQ ID NO: 851504 - protein, 1722 aa, Homo sapiens; identical to SEQ ID NO: 851503

SEQ ID NO: 851505 - protein, 1716 aa, Homo sapiens
GAVGCLQACAVSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQTDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRTASPQQREMMDQAAAQLAQDNCELACCFIQKTAVEKAGPEMDKRLATEFELRKHARQEGRRYCDPVVLTYQAERMPEQIRLKVGGVDPKQLAVYEEFARNVPGFLPTNDLSQPTGFLAQPMKQAWATDDVAQIYDKCITELEQHLHAIPPTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKVDMLSEINIAPRILTNFTGVMPPQFKKDLDSYLKTRSPVTFLSDLRSNLQVSNEPGNRYNLQLINALVLYVGTQAIAHIHNKGSTPSMSTITHSAHMDIFQNLAVDLDTEGRYLFLNAIANQLRYPNSHTHYFSCTMLYLFAEANTEAIQEQITRVLLERLIVNRPHPWGLLITFIELIKNPAFKFWNHEFVHCAPEIENNGRDRCQLDETASLLYVSV

SEQ ID NO: 851506 - protein, 3344 aa, Homo sapiens
GAVGCLQACAVSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQTDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRTASPQQREMMDQAAAQLAQDNCELACCFIQKTAVEKAGPEMDKRLATEFELRKHARQEGRRYCDPVVLTYQAERMPEQIRLKVGGVDPKQLAVYEEFARNVPGFLPTNDLSQPTGFLAQPMKQAWATDDVAQIYDKCITELEQHLHAIPPTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKVDMLSEINIAPRILTNFTGVMPPQFKKDLDSYLKTRSPVFQTVPCKHHIFQMEKLPTGPEVHTANVLFIETIFSKYKYMALRFRTYYRPDNQVLIFLEEGLKSNKFPVTMFLQINLIIRGFIFLHVFVFSILVFKTRLEVSSIPQKANGFSLQYEIIHKNNLFPKLIPNNQSVLKMYLFLYNVNGNLGKMYPGTLKLVIEKDLTSFIIEVLKHKYLQLDLLFDNDCRSLEFNIYNVHSCTQNTYHYHTTYSSCLKRRIFRFFKSLASQSMPCSNNFELKLHSQIFNKLSTHTLLMLFLIFHVVLPNLKPASKRSSDFEKMKYKVVISKRSMGGQNSRFPNGIIFYFTAMNDCFSKKNPLLDSFTLFGNWPKNLKNVLEYMRFFIQSALIGTPGSCNSFEASPIERGYHTDSQDTHQFVEIPEKVMILKNLDCTCFTSLFHCIGKLQLVYQHSYYLSYPRFARNSYGFPISQVIFYKLEGIIISPNSRFVVSKYHFTVLFIVKYPYEHQPSMRKGSPQTFNTLQLGISCTKTHEKKKLMVGISDKNLFDMQPSGLFIAKSKLIAVNLLHPFEINKLYEIQILAIDIRCKNKINRLNLHISFAHKLAHTIILQNRQLQQKKKKTALLQTSLKASLQRRQKINMHIYMYKVLLFNTNAISRKNLTAEAKKHKQKPKEKKNVQHLKPLKHQNKKHTKITVFMTINITQIKNIDQNSGSKYLELIDCLLLGEFFFNLNVFSSLKKNLKVLTLYKAGKFFKYFAIKYSQFFIDLNKKRRINKVKQEDKTWRKKGQVVAGQSNKMLLYHLSLLISIKHISYQIPAGLVHSLRFTKIYTTINRYTEKVLRKRMPLKNQHQILIKAILKGCLLSKMNIKCNIPYKLRTETLFKVSLLLPLSCFFKIEHINQMAIEVFAVIFSLSERTITEDTNKISLSRFDCQGFLCIFSAKILVELAEPHAIQNHHYPLTCCHLGHFLHGCGCLHLHQFPETHFAAIVAGGDASAVLDTASRSSTAEGGSIGETGSSTVEFIPVRFSLVFDQCPFSFHKLYCQSDVYHLKFHPLAYSSFVQRMKYEVDSLILAARPGRLSSASSAPTFRRGASLFPSPVLSNFWSPDASSLKFSFGSGGDGGERSSVLTLSFRSQLSLTGTKPTSIRTCSFRALSLCMLDFSFLSFRRGGFLEIGSMEGEALWEEVAPSEQAPSEPPPWEETTPSEQAPSGPPLWEETALSYQVPSGPPPWEETALSEQAPSGPPPWEETAPSEQAPSGPPAWEQILPGQPPSEQVPWEQAPFGQPPSEQSPWEEAAPCEQVQFGHPPSEQAPREAAAPSEQAPPEPPPSEQARQEQAVSGHPPSEHAPWEVAAPPERAPSEPPLWEQAPSEEGPSEQIPSQQVPSEEAYCFSYLIYFSEFSSLYFFSCKYFAFYSPPLCCHPLALPDYYFVDLLSTFFFFFVEDSSSFTGPCKEWLSTSSFLLLFLVLLNFSELLPVCTSISFTSVTDFRVLVVTWITDTLLEGFFSFETSLFSALTDFSFFFPATSPFIFVCSISVFSLVILSGKSASRFLVFFSFTFETSIVLLGQVGCLDLKDTVDYTSWKLHVTYRAIELPWVHMWLYMFFEVASICCFVITVWAIKRFRPIVNLSCMAGYFMLIRGHITALITFKWLLTMNEYAYVKLDESSENLSKDKVHIYMGVLLYEFYHAEHNCFFCLKNSCIFHMCILSLENGFLNVSSSDTAHCCVCANDTLVDSLIIPSSGVVFQVCCIVIISISIVAAAVTANGALEKSPSSAVEERFPAFACFSALSSNKKFLSTVNSDVMHKLFFRFCFILAWLTAKGFGLRALAFVLRSRCFRGKIFI

SEQ ID NO: 851507 - protein, 1652 aa, Homo sapiens
GAVGCLQACAVSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQTDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRTASPQQREMMDQAAAQLAQDNCELACCFIQKTAVEKAGPEMDKRLATEFELRKHARQEGRRYCDPVVLTYQAERMPEQIRLKVGGVDPKQLAVYEEFARNVPGFLPTNDLSQPTGFLAQPMKQAWATDDVAQIYDKCITELEQHLHAIPPTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKVDMLSEINIAPRILTNFTGVMPPQFKKDLDSYLKTRSPVTFLSDLRSNLQVSNEPGNRYNLQLINALVLYVGTQAIAHIHNKGSTPSMSTITHSAHMDIFQNLAVDLDTEGRYLFLNAIANQLRYPNSHTHYFSCTMLYLFAEANTEAIQEQITR

SEQ ID NO: 851508 - protein, 1528 aa, Homo sapiens
GAVGCLQACAVSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQTDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRTASPQQREMMDQAAAQLAQDNCELACCFIQKTAVEKAGPEMDKRLATEFELRKHARQEGRRYCDPVVLTYQAERMPEQIRLKVGGVDPKQLAVYEEFARNVPGFLPTNDLSQPTGFLAQPMKQAWATDDVAQIYDKCITELEQHLHAIPPTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDHDRVSDERKKFESAEERTTKKAITITISETENETQISR

SEQ ID NO: 851509 - protein, 897 aa, Homo sapiens
GAVGCLQACAVSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQTDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRVSWLFPWYRYKTYYCLSVIIFFFVYIWHWALPLILNNHHICLMSSIILDCNSVRQSIMSVCFFFFLLYSQPDV

SEQ ID NO: 851510 - protein, 1722 aa, Homo sapiens; identical to SEQ ID NO: 851503

SEQ ID NO: 851511 - protein, 1722 aa, Homo sapiens; identical to SEQ ID NO: 851503

SEQ ID NO: 851512 - protein, 1749 aa, Homo sapiens
GAVGCLQACAVSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQTDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRTASPQQREMMDQAAAQLAQDNCELACCFIQKTAVEKAGPEMDKRLATEFELRKHARQEGRRYCDPVVLTYQAERMPEQIRLKVGGVDPKQLAVYEEFARNVPGFLPTNDLSQPTGFLAQPMKQAWATDDVAQIYDKCITELEQHLHAIPPTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKYCRKYHSLAPQIRRNVTAMYGVNLTKKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKVDMLSEINIAPRILTNFTGVMPPQFKKDLDSYLKTRSPVTFLSDLRSNLQVSNEPGNRYNLQLINALVLYVGTQAIAHIHNKGSTPSMSTITHSAHMDIFQNLAVDLDTEGRYLFLNAIANQLRYPNSHTHYFSCTMLYLFAEANTEAIQEQITRVLLERLIVNRPHPWGLLITFIELIKNPAFKFWNHEFVHCAPEIEKLFQSVAQCCMGQKQAQQVMEGTGAS

SEQ ID NO: 851513 - protein, 1697 aa, Homo sapiens
GAVGCLQACAVSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQTDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRTASPQQREMMDQAAAQLAQDNCELACCFIQKTAVEKAGPEMDKRLATEFELRKHARQEGRRYCDPVVLTYQAERMPEQIRLKVGGVDPKQLAVYEEFARNVPGFLPTNDLSQPTGFLAQPMKQAWATDDVAQIYDKCITELEQHLHAIPPTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKVDMLSEINIAPRILTNFTGVMPPQFKKDLDSYLKTRSPVTFLSDLRSNLQVSNEPGNRYNLQLINALVLYVGTQAIAHIHNKGSTPSMSTITHSAHMDIFQNLAVDLDTEGRYLFLNAIANQLRYPNSHTHYFSCTMLYLFAEANTEAIQEQITRVLLERLIVNRPHPWGLLITFIELIKNPAFKFWNHEFVHCAPEIEK

SEQ ID NO: 851514 - protein, 1722 aa, Homo sapiens; identical to SEQ ID NO: 851503

SEQ ID NO: 851515 - protein, 1704 aa, Homo sapiens
GAVGCLQACAVSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQTDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRTASPQQREMMDQAAAQLAQDNCELACCFIQKTAVEKAGPEMDKRLATEFELRKHARQEGRRYCDPVVLTYQAERMPEQIRLKVGGVDPKQLAVYEEFARNVPGFLPTNDLSQPTGFLAQPMKQAWATDDVAQIYDKCITELEQHLHAIPPTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKVDMLSEINIAPRILTNFTGVMPPQFKKDLDSYVSNEPGNRYNLQLINALVLYVGTQAIAHIHNKGSTPSMSTITHSAHMDIFQNLAVDLDTEGRYLFLNAIANQLRYPNSHTHYFSCTMLYLFAEANTEAIQEQITRVLLERLIVNRPHPWGLLITFIELIKNPAFKFWNHEFVHCAPEIEKLFQSVAQCCMGQKQAQQVMEGTGAS

SEQ ID NO: 851516 - protein, 1722 aa, Homo sapiens; identical to SEQ ID NO: 851503

SEQ ID NO: 851517 - protein, 391 aa, Homo sapiens
GDVTSMIHCTRRTERRLCEPLVSTDLVIAMLDVLALEIYRSSRDLLIIIKGLTTSMRRAWTIVSAFSGSRMDQSYARLVEDDVSISNTVGNSPYIYCDMSSNSMAQLIMEWRSMDILLHDFPEFLCDYHYGFCDVIPPNCIQLRNLILSAFPRNMRLPDPFTPNLKVDMLSEINIAPRILTNFTGVMPPQFKKDLDSYLKTRSPVTFLSDLRSNLQVSNEPGNRYNLQLINALVLYVGTQAIAHIHNKGSTPSMSTITHSAHMDIFQNLAVDLDTEGRYLFLNAIANQLRYPNSHTHYFSCTMLYLFAEANTEAIQEQITRVLLERLIVNRPHPWGLLITFIELIKNPAFKFWNHEFVHCAPEIEKLFQSVAQCCMGQKQAQQVMEGTGAS

SEQ ID NO: 851518 - protein, 157 aa, Homo sapiens
FCFAHFKVSNEPGNRYNLQLINALVLYVGTQAIAHIHNKGSTPSMSTITHSAHMDIFQNLAVDLDTEGRYLFLNAIANQLRYPNSHTHYFSCTMLYLFAEANTEAIQEQITRVLLERLIVNRPHPWGLLITFIELIKNPAFKFWNHEFVHCAPEIEK

SEQ ID NO: 851519 - protein, 110 aa, Homo sapiens
MSGNKPEAAILHLFSSNQDREGIIISIHNIYLERQRETPVFPFVWNFLALCKLCPRQVHKLVPCNEEAADAMHLSEGIAPCLLTFLVSQRIAKSQFEYYVTYFFNVDRGP

SEQ ID NO: 851520 - protein, 1535 aa, Homo sapiens
GAVGCLQACAVSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQTDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRTASPQQREMMDQAAAQLAQDNCELACCFIQKTAVEKAGPEMDKRLATEFELRKHARQEGRRYCDPVVLTYQAERMPEQIRLKVGGVDPKQLAVYEEFARNVPGFLPTNDLSQPTGFLAQPMKQAWATDDVAQIYDKCITELEQHLHAIPPTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQVELLERKMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDHDRVSDERKKFESAEERTTKKAITITISETENETQISR

SEQ ID NO: 851521 - protein, 96 aa, Homo sapiens
GRNAPRGADETAGLERPSRPRPPPEAACSGLSWRYEVPVQVSDFGLVRWWRRSRAGLVRMITDVQLAIFANMLGVSLFLLVVLYHYVAVNNPKKQE

SEQ ID NO: 851522 - protein, 78 aa, Homo sapiens
VAGPWGEDGFLRGRGVRQPAAQPLSSPQDDHGRAARHLRQHAGRVALLACRSLSLRGRQQSQEAGMKVALSPPQGSRT

SEQ ID NO: 851523 - protein, 96 aa, Homo sapiens; identical to SEQ ID NO: 851521

SEQ ID NO: 851524 - protein, 96 aa, Homo sapiens; identical to SEQ ID NO: 851521

SEQ ID NO: 851525 - protein, 69 aa, Homo sapiens
VNNPKKQEGKWRFLRPRVPGHSLRQDGGYEEAFTLHFIPSTHHNMLGVSLFLLVVLYHYVAVNNPKKQE

SEQ ID NO: 851526 - protein, 96 aa, Homo sapiens; identical to SEQ ID NO: 851521

SEQ ID NO: 851527 - protein, 96 aa, Homo sapiens; identical to SEQ ID NO: 851521

SEQ ID NO: 851528 - protein, 96 aa, Homo sapiens; identical to SEQ ID NO: 851521

SEQ ID NO: 851529 - protein, 96 aa, Homo sapiens; identical to SEQ ID NO: 851521

SEQ ID NO: 851530 - protein, 502 aa, Homo sapiens
MSGRRFHLSTTDRVIKAVPFPPTQRLTFKEVFENGKPKVDVLKNHLVKEGRLEEEVALKIINDGAAILRQEKTMIEVDAPITVCGDIHGQFFDLMKLFEVGGSPSNTRYLFLGDYVDRGYFSIECVLYLWSLKINHPKTLFLLRGNHECRHLTDYFTFKQECRIKYSEQVYDACMETFDCLPLAALLNQQFLCVHGGMSPEITSLDDIRKLDRFTEPPAFGPVCDLLWSDPSEDYGNEKTLEHYTHNTVRGCSYFYSYPAVCEFLQNNNLLSIIRAHEAQDAGYRMYRKSQATGFPSLITIFSAPNYLDVYNNKAAVLKYENNVMNIRQFNCSPHPYWLPNFMDVFTWSLPFVGEKVTEMLVNVLNICSDDELISDDEAEGSTTVRKEIIRNKIRAIGKMARVFSILRQESESVLTLKGLTPTGTLPLGVLSGGKQTIETAIRGFSLQHKIRSFEEARGLDRINERMPPRKDSIHAGGPMKSVTSAHSHAAHRSDQGKKAHS

SEQ ID NO: 851531 - protein, 512 aa, Homo sapiens
MSGRRFHLSTTDRVIKAVPFPPTQRLTFKEVFENGKPKVDVLKNHLVKEGRLEEEVALKIINDGAAILRQEKTMIEVDAPITVCGDIHGQFFDLMKLFEVGGSPSNTRYLFLGDYVDRGYFSIECVLYLWSLKINHPKTLFLLRGNHECRHLTDYFTFKQECRIKYSEQVYDACMETFDCLPLAALLNQQFLCVHGGMSPEITSLDDIRKLDRFTEPPAFGPVCDLLWSDPSEDYGNEKTLEHYTHNTVRGCSYFYSYPAVCEFLQNNNLLSIIRAHEAQDAGYRMYRKSQATGFPSLITIFSAPNYLDVYNNKAAVLKYENNVMNIRQFNCSPHPYWLPNFMDVFTWSLPFVGEKVTEMLVNVLNICSDDELISDDEAEGSTTVRKEIIRNKIRAIGKMARVFSILRQESESVLTLKGLTPTGTLPLGVLSGGKQTIETATVEAVEAREAIRGFSLQHKIRSFEEARGLDRINERMPPRKDSIHAGGPMKSVTSAHSHAAHRSDQGKKAHS

SEQ ID NO: 851532 - protein, 168 aa, Homo sapiens
MSGRRFHLSTTDRVIKAVPFPPTQRLTFKEVFENGKPKVDVLKNHLVKEGRLEEEVALKIINDGAAILRQEKTMIEVDAPITVCGDIHGQFFDLMKLFEVGGSPSNTRYLFLGDYVDRGYFSIERWGPAMLPRLECSGYTQVRSFRTSASNSWIQAILLPQLPEYMEL

SEQ ID NO: 851533 - protein, 502 aa, Homo sapiens; identical to SEQ ID NO: 851530

SEQ ID NO: 851534 - protein, 521 aa, Homo sapiens
MSGRRFHLSTTDRVIKAVPFPPTQRLTFKEVFENGKPKVDVLKNHLVKEGRLEEEVALKIINDGAAILRQEKTMIEVDAPITVCGDIHGQFFDLMKLFEVGGSPSNTRYLFLGDYVDRGYFSIECVLYLWSLKINHPKTLFLLRGNHECRHLTDYFTFKQECRIKYSEQVYDACMETFDCLPLAALLNQQFLCVHGGMSPEITSLDDIRKLDRFTEPPAFGPVCDLLWSDPSEDYGNEKTLEHYTHNTVRGCSYFYSYPAVCEFLQNNNLLSIIRAHEAQDAGYRMYRKSQATGFPSLITIFSAPNYLDVYNNKAAVLKYENNVMNIRQFNCSPHPYWLPNFMDVFTWSLPFVGEKVTEMLVNVLNICSDDELISDDEAEDHYIPSYQKGSTTVRKEIIRNKIRAIGKMARVFSILRQESESVLTLKGLTPTGTLPLGVLSGGKQTIETATVEAVEAREAIRGFSLQHKIRSFEEARGLDRINERMPPRKDSIHAGGPMKSVTSAHSHAAHRSDQGKKAHS

SEQ ID NO: 851535 - protein, 512 aa, Homo sapiens; identical to SEQ ID NO: 851531

SEQ ID NO: 851536 - protein, 495 aa, Homo sapiens
MSGRRFHLSTTDRVIKAVPFPPTQRLTFKEVFENGKPKVDVLKNHLVKEGRLEEEVALKIINDGAAILRQEKTMIEVDAPITVCGDIHGQFFDLMKLFEVGGSPSNTRYLFLGDYVDRGYFSIECVLYLWSLKINHPKTLFLLRGNHECRHLTDYFTFKQECRIKYSEQVYDACMETFDCLPLAALLNQQFLCVHGGMSPEITSLDDIRKLDRFTEPPAFGPVCDLLWSDPSEDYGNEKTLEHYTHNTVRGCSYFYSYPAVCEFLQNNNLLSIIRAHEAQDAGYRMYRKSQATGFPSLITIFSAPNYLDVYNNKAAVLKYENNVMNIRQFNCSPHPYWLPNFMDVFTWSLPFVGEKVTEMLVNVLNICSDDELISDDEAEGSTTVRKEIIRNKIRAIGKMARVFSILRQESESVLTLKGLTPTGTLPLGVLSGGKQTIETATVEAVEAREALMQRQKLKQLVMRGQVVYFCIPSMYKRHPFDSQESQIGQPLQRF

SEQ ID NO: 851537 - protein, 358 aa, Homo sapiens
CCSEDPDDVEQRLFQYRGRIKYSEQVYDACMETFDCLPLAALLNQQFLCVHGGMSPEITSLDDIRKLDRFTEPPAFGPVCDLLWSDPSEDYGNEKTLEHYTHNTVRGCSYFYSYPAVCEFLQNNNLLSIIRAHEAQDAGYRMYRKSQATGFPSLITIFSAPNYLDVYNNKAAVLKYENNVMNIRQFNCSPHPYWLPNFMDVFTWSLPFVGEKVTEMLVNVLNICSDDELISDDEAEGSTTVRKEIIRNKIRAIGKMARVFSILRQESESVLTLKGLTPTGTLPLGVLSGGKQTIETAIRGFSLQHKIRSFEEARGLDRINERMPPRKDSIHAGGPMKSVTSAHSHAAHRSDQGKKAHS

SEQ ID NO: 851538 - protein, 78 aa, Homo sapiens
KGLTPTGTLPLGVLSGGKQTIETGEYESAPPWKVCSRYLTVSTHLQMGAFLRKCHESSWLYHKRGNESSPLLPSIQKT

SEQ ID NO: 851539 - protein, 141 aa, Homo sapiens
MSGRRFHLSTTDRVIKAVPFPPTQRLTFKEVFENGKPKVDVLKNHLVKEGRLEEEVALKIINDGAAILRQEKTMIEVDAPITVCGDIHGQFFDLMKLFEVGGSPSNTRYLFLGDYVDRGYFSIEVKIKLDMLGLLYCLSKK

SEQ ID NO: 851540 - protein, 325 aa, Homo sapiens
MSGRRFHLSTTDRVIKAVPFPPTQRLTFKEVFENGKPKVDVLKNHLVKEGRLEEEVALKIINDGAAILRQEKTMIEVDAPITVCGDIHGQFFDLMKLFEVGGSPSNTRYLFLGDYVDRGYFSIECVLYLWSLKINHPKTLFLLRGNHECRHLTDYFTFKQECRIKYSEQVYDACMETFDCLPLAALLNQQFLCVHGGMSPEITSLDDIRKLDRFTEPPAFGPVCDLLWSDPSEDYGNEKTLEHYTHNTVRGCSYFYSYPAVCEFLQNNNLLSIIRAHEAQDAGYRMYRKSQATGFPSLITIFSAPNYLDVYNNKESATHSFDYPQ

SEQ ID NO: 851541 - protein, 395 aa, Homo sapiens
MSGRRFHLSTTDRVIKAVPFPPTQRLTFKEVFENGKPKVDVLKNHLVKEGRLEEEVALKIINDGAAILRQEKTMIEVDAPITVCGDIHGQFFDLMKLFEVGGSPSNTRYLFLGDYVDRGYFSIECVLYLWSLKINHPKTLFLLRGNHECRHLTDYFTFKQECRIKYSEQVYDACMETFDCLPLAALLNQQFLCVHGGMSPEITSLDDIRKLDRFTEPPAFGPVCDLLWSDPSEDYGNEKTLEHYTHNTVRGCSYFYSYPAVCEFLQNNNLLSIIRAHEAQDAGYRMYRKSQATGFPSLITIFSAPNYLDVYNNKAAVLKYENNVMNIRQFNCSPHPYWLPNFMDVFTWSLPFVGEKVTEMLVNVLNICSDDELISDDEAEEGTYSFVREVLRGLG

SEQ ID NO: 851542 - protein, 109 aa, Homo sapiens
MTFTRRVLHSHLSVCFSRRLLCAKKLFLSLLLCCLIELSPPASCFSVAIRGFSLQHKIRSFEEARGLDRINERMPPRKDSIHAGGPMKSVTSAHSHAAHRSDQGKKAHS

SEQ ID NO: 851543 - protein, 100 aa, Homo sapiens
GPPPPPGRGRARQPPPARRLPLGSWEPRRYGPAEHSGGRRAGWAPAQWPSLDRKAEAASGPRPGVSGCVTLAKMLKLFSWLPNGADRLTCCLRNLRDQIK

SEQ ID NO: 851544 - protein, 72 aa, Homo sapiens
AQEKQGLREESNCDIEKSLSSPFPVVALGPRPGFQKMGQLYSGVKANYCLAARVSPGRRILAFCLWKFLLHP

SEQ ID NO: 851545 - protein, 410 aa, Homo sapiens
RRFRSLQRVVGWVVRVGAGAAERVLGFRYQDLRQKIRPVAKELQFNYIPVDAEIVSIDTFNKSPPKRGLVVGITFIKDSGDKGSPFLNIYCDYEPGSEYNLDSIAQSCLNLELQFTPFQLCHAEVQVGDQLETVFLLSGNDPAIHLYKENEGLHQFEEQPVENLFPELTNLTSSVLWLDVHNFPGTSRRLSALGCQSGYVRVAHVDQRSREVLQMWSVLQDGPISRVIVFSLSAAKETKDRPLQDEYSVLVASMLEPAVVYRDLLNRGLEDQLLLPGSDQFDSVLCSLVTDVDLDGRPEVLVATYGQELLCYKYRGPESGLPEAQHGFHLLWQRSFSSPLLAMAHVDLTGDGLQELAVVSLKGVHILQHSLIQASELVLTRLRHQVEQRRRRLQGLEDGAGAGPAENAAS

SEQ ID NO: 851546 - protein, 390 aa, Homo sapiens
LGGGGLERGVEKASEALSEPGHRAGRMGSVDAEIVSIDTFNKSPPKRGLVVGITFIKDSGDKGSPFLNIYCDYEPGSEYNLDSIAQSCLNLELQFTPFQLCHAEVQVGDQLETVFLLSGNDPAIHLYKENEGLHQFEEQPVENLFPELTNLTSSVLWLDVHNFPGTSRRLSALGCQSGYVRVAHVDQRSREVLQMWSVLQDGPISRVIVFSLSAAKETKDRPLQDEYSVLVASMLEPAVVYRDLLNRGLEDQLLLPGSDQFDSVLCSLVTDVDLDGRPEVLVATYGQELLCYKYRGPESGLPEAQHGFHLLWQRSFSSPLLAMAHVDLTGDGLQELAVVSLKGVHILQHSLIQASELVLTRLRHQVEQRRRRLQGLEDGAGAGPAENAAS

SEQ ID NO: 851547 - protein, 435 aa, Homo sapiens [sequence omitted]

SEQ ID NO: 851548 - protein, 379 aa, Homo sapiens
MGEAAVAAGPCPLREDSFTRFSSQSNVYGLAGGAGGRGELLAATLKGKVLGFRYQDLRQKIRPVAKELQFNYIPESCLNLELQFTPFQLCHAEVQVGDQLETVFLLSGNDPAIHLYKENEGLHQFEEQPVENLFPELTNLTSSVLWLDVHNFPGTSRRLSALGCQSGYVRVAHVDQRSREVLQMWSVLQDGPISRVIVFSLSAAKETKDRPLQDEYSVLVASMLEPAVVYRDLLNRGLEDQLLLPGSDQFDSVLCSLVTDVDLDGRPEVLVATYGQELLCYKYRGPESGLPEAQHGFHLLWQRSFSSPLLAMAHVDLTGDGLQELAVVSLKGVHILQHSLIQASELVLTRLRHQVEQRRRRLQGLEDGAGAGPAENAAS

SEQ ID NO: 851549 - protein, 384 aa, Homo sapiens
MGEAAVAAGPCPLREDSFTRFSSQSNVYGLAGGAGGRGELLAATLKGKVLGFRYQDLRQKIRPVAKELQFNYIPVDAEIVSIDTFNKSPPKRGLVVGITFIKDSGDKGSPFLNIYCDYEPGSEYNLDSIAQSCLNLELQFTPFQLCHAEVQVGDQLETVFLLSGNDPAIHLYKENEGLHQFEEQPVENLFPELTNLTSSVLWLDVHNFPGTSRRLSALGCQSGYVRVAHVDQRSREVLQMWSVLQDGPISRVIVFSLSAAKETKDRPLQDEYSVLVASMLEPAVVYRDLLNRGLEDQLLLPGSDQFDSVLCSLVTDVDLDGRPEVLVATYGQELLCYKYRGPESGLPEAQHGFHLLWQRSFSSPLDGCKPGGPRPRNFGTPMGH

SEQ ID NO: 851550 - protein, 134 aa, Homo sapiens
MLIFLSSIENILGIFLAEILGILIKCLYFHSTTSVSEEDVSSRYSRTDRSGFPRYNRDANVSGTLVSSSTLEKKIEDLEKEVVRERQENLRLVRLMQDKEEMIGKLKEEIDLLNRDLDDIEMLIETSKLGEPAR

SEQ ID NO: 851551 - protein, 340 aa, Homo sapiens
MATGGYRTSSGLGGSTTDFLEEWKAKREKMRAKQNPPGPAPPGGGSSDAAGKPPAGALGTPAAAAANELNNNLPGGAPAAPAVPGPGGVNCAVGSAMLTRAAPGPRRSEDEPPAASASAAPPPQRDEEEPDGVPEKGKSSGPSARKGKGQIEKRKLREKRRSTGVVNIPAAECLDEYEDDEAGQKERKREDAITQQNTIQNEAVNLLDPGSSYLLQEPPRTVSGRYKSTTSVSEEDVSSRYSRTDRSGFPRYNRDANVSGTLVSSSTLEKKIEDLEKEVVRERQENLRLVRLMQDKEEMIGKLKEEIDLLNRDLDDIEDENEQLKQENKTLLKVVGQLTR

SEQ ID NO: 851552 - protein, 340 aa, Homo sapiens; identical to SEQ ID NO: 851551

SEQ ID NO: 851553 - protein, 340 aa, Homo sapiens; identical to SEQ ID NO: 851551

SEQ ID NO: 851554 - protein, 175 aa, Homo sapiens
KERKREDAITQQNTMQNEAVNLLDPGSSYLLQCLDEYEDDEAGQKERKREDAITQQNTIQNEAVNLLDPGSSYLLQEPPRTVSGRYKSTTSVSEEDVSSRYSRTDRSGFPRYNRDANVSGTLVSSSTLEKKIEDLEKEVVRERQENLRLVRLMQDKEEMIGKLKEEIDLLNRGPR

SEQ ID NO: 851555 - protein, 118 aa, Homo sapiens
MLIFLSSIENILGIFLAEILGILIKCLYFHSTTSVSEEDVSSRYSRTDRSGFPRYNRDANVSGTLVSSSTLEKKIEDLEKEVVRERQENLRLVRLMQDKEEMIGKLKEEIDLLNRGPR

SEQ ID NO: 851556 - protein, 162 aa, Homo sapiens [sequence omitted]

SEQ ID NO: 851557 - protein, 162 aa, Homo sapiens [sequence omitted]

SEQ ID NO: 851558 - protein, 227 aa, Homo sapiens
MGRPLLLPLLLLLQPPAFLQPGGSTGSGPSYLYGVTQPKHLSASMGGSVEIPFSFYYPWELAIVPNVRISWRRGHFHGQSFYSTRPPSIHKDYVNRLFLNWTEGQESGFLRISNLRKEDQSVYFCRVELDTRRSGRQQLQSIKGTKLTITQAVTTTTTWRPSSTTTIAGLRVTESKGHSESWHLSLDTAIRVALAVAVLKTVILGLLCLLLLWWRRRKGSRAPSSDF

SEQ ID NO: 851559 - protein, 271 aa, Homo sapiens
MGRASYGGSPVGHQSSSDHPRAKTCRSPVRDGPRTLCGVPTVALSLHFLREASSGSRTCGRRTSLCTSAKSSWTYRSGRLSWQSIKGTHLTITQALRQPLHRAPLLPGQLCWSPRPLEKNKAMGRPLLLPLLLLLQPPAFLQPGLCEPALSELDRGSGERLPQDLKPAEGGPVCVFLPSRAGHPEIREAAVAVHQGDQTHHHPGCHNHHHLEAQQHNHHSRPQGHRKQRALRIMAPKSGHCHQGCIGCRCAQNCHFGTAVPPPPVVEEKER

SEQ ID NO: 851560 - protein, 162 aa, Homo sapiens [sequence omitted]

SEQ ID NO: 851561 - protein, 227 aa, Homo sapiens; identical to SEQ ID NO: 851558

SEQ ID NO: 851562 - protein, 227 aa, Homo sapiens; identical to SEQ ID NO: 851558

SEQ ID NO: 851563 - protein, 162 aa, Homo sapiens [sequence omitted]

SEQ ID NO: 851564 - protein, 227 aa, Homo sapiens; identical to SEQ ID NO: 851558

SEQ ID NO: 851565 - protein, 162 aa, Homo sapiens [sequence omitted]

SEQ ID NO: 851566 - protein, 227 aa, Homo sapiens; identical to SEQ ID NO: 851558

SEQ ID NO: 851567 - protein, 162 aa, Homo sapiens [sequence omitted]

SEQ ID NO: 851568 - protein, 162 aa, Homo sapiens [sequence omitted]

SEQ ID NO: 851569 - protein, 162 aa, Homo sapiens [sequence omitted]

SEQ ID NO: 851570 - protein, 145 aa, Homo sapiens
CSGLGTESTSMGTQPGLPGCSPRPLCHYQHQLLPSYFGHSSPPTGGRPGGHHSPPTPHTGPRALLPGPPHPSLHMAALSLLRMDSTLRLGRGLPALVLASLFSLTLGAQGHGGTLRSSMRETMRPLGFPLPRPPGCHPLTLFLGL

SEQ ID NO: 851571 - protein, 145 aa, Homo sapiens; identical to SEQ ID NO: 851570

SEQ ID NO: 851572 - protein, 162 aa, Homo sapiens [sequence omitted]

SEQ ID NO: 851573 - protein, 162 aa, Homo sapiens [sequence omitted]

SEQ ID NO: 851574 - protein, 227 aa, Homo sapiens; identical to SEQ ID NO: 851558

SEQ ID NO: 851575 - protein, 349 aa, Homo sapiens
MGRASYGGSPVGHQSSSDHPRAKTCRSPVRDGPRTLCGVPTVALSLHFLREASSGSRTCGRRTSLCTSAKSSWTYRSGRLSWQSIKGTHLTITQALRQPLHRAPLLPGQLCWSPRPLEKNKAMGRPLLLPLLLLLQPPAFLQPGGSTGSGPSYLYGVTQPKHLSASMGGSVEIPFSFYYPWELAIVPNVRISWRRGHFHGQSFYSTRPPSIHKDYVNRLFLNWTEGQESGFLRISNLRKEDQSVYFCRVELDTRRSGRQQLQSIKGTKLTITQAVTTTTTWRPSSTTTIAGLRVTESKGHSESWHLSLDTAIRVALAVAVLKTVILGLLCLLLLWWRRRKGSRAPSSDF

SEQ ID NO: 851576 - protein, 162 aa, Homo sapiens [sequence omitted]

SEQ ID NO: 851577 - protein, 227 aa, Homo sapiens; identical to SEQ ID NO: 851558

SEQ ID NO: 851578 - protein, 162 aa, Homo sapiens [sequence omitted]

SEQ ID NO: 851579 - protein, 162 aa, Homo sapiens [sequence omitted]

SEQ ID NO: 851580 - protein, 162 aa, Homo sapiens [sequence omitted]

SEQ ID NO: 851581 - protein, 162 aa, Homo sapiens [sequence omitted]

SEQ ID NO: 851582 - protein, 162 aa, Homo sapiens [sequence omitted]

SEQ ID NO: 851583 - protein, 85 aa, Homo sapiens
MAPKSGHCHQGCIGCRCAQNCHFGTAVPPPPVVEEKERVSAQNALSPQASQLGVSLSPPAAKGLQKYADPAGSPQAHQGRLWPVL

SEQ ID NO: 851584 - protein, 181 aa, Homo sapiens
MAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTIQMPFLKKHFLDC

SEQ ID NO: 851585 - protein, 173 aa, Homo sapiens
MAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFYRRPEINHYS

SEQ ID NO: 851586 - protein, 555 aa, Homo sapiens
MAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTLVIIVSLGYGIVKPRLGVTLHKVVVAGALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 851587 - protein, 529 aa, Homo sapiens
RPGDLEDPHAARRSNGYIPIPSGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTLVIIVSLGYGIVKPRLGVTLHKVVVAGALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 851588 - protein, 494 aa, Homo sapiens
MAHSDTVVDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTLVIIVSLGYGIVKPRLGVTLHKVVVAGALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 851589 - protein, 414 aa, Homo sapiens
MHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTLVIIVSLGYGIVKPRLGVTLHKVVVAGALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 851590 - protein, 555 aa, Homo sapiens; identical to SEQ ID NO: 851586

SEQ ID NO: 851591 - protein, 210 aa, Homo sapiens
MEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 851592 - protein, 555 aa, Homo sapiens; identical to SEQ ID NO: 851586

SEQ ID NO: 851593 - protein, 555 aa, Homo sapiens; identical to SEQ ID NO: 851586

SEQ ID NO: 851594 - protein, 555 aa, Homo sapiens; identical to SEQ ID NO: 851586

SEQ ID NO: 851595 - protein, 480 aa, Homo sapiens
MAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTLVIIVSLGYGIVKPRLGVTLHKVVVAGALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFLDSSVYSANMR

SEQ ID NO: 851596 - protein, 181 aa, Homo sapiens; identical to SEQ ID NO: 851584

SEQ ID NO: 851597 - protein, 181 aa, Homo sapiens; identical to SEQ ID NO: 851584

SEQ ID NO: 851598 - protein, 150 aa, Homo sapiens
MLGILPAYSALSWGSGCSELMLASPNFHFDFSNFQPGPFVFSSRTQARQKTVSRAGSRKVRMLDVHSSHFLPSAKRSWELRVSSLSCGTVLGPWEGKNYGKRVPQVFLPTLIQLVSCFPIVQKTLNWFLDFPQREFFHVLLNQCVCRGKE

SEQ ID NO: 851599 - protein, 540 aa, Homo sapiens
MAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTAMHEPLQTWQDAPYIFIVHIGISSSKESSKENSLSNLFTMTVEVKGPYEYLTLEDYPLMIWLAWSACYWRDLLRIQFWIGAVIFLGMLEKAVFYAEFQNIRYKGESVQGALILAELLSAVKRSLARTLVIIVSLGYGIVKPRLGVTLHKVVVAGALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 851600 - protein, 414 aa, Homo sapiens; identical to SEQ ID NO: 851589

SEQ ID NO: 851601 - protein, 517 aa, Homo sapiens
MAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKTFSGDFMHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTLVIIVSLGYGIVKPRLGVTLHKVVVAGALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 851602 - protein, 555 aa, Homo sapiens; identical to SEQ ID NO: 851586

SEQ ID NO: 851603 - protein, 203 aa, Homo sapiens
MYFLFPLTLIVNLALSAVDACVILWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 851604 - protein, 555 aa, Homo sapiens; identical to SEQ ID NO: 851586

SEQ ID NO: 851605 - protein, 505 aa, Homo sapiens
MAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTLVIIVSLGYGIVKPRLGVTLHKVVVAGALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQSCFPMSEERRRLTTGAMWKKLEDEMGVHTEQWIVVTRQ

SEQ ID NO: 851606 - protein, 398 aa, Homo sapiens [sequence omitted]

SEQ ID NO: 851607 - protein, 120 aa, Homo sapiens
MAHSDTVVDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTIQMPFLKKHFLDC

SEQ ID NO: 851608 - protein, 129 aa, Homo sapiens
HHNTHTNPHNRLGTGLVCSRRIWPPPYRSKPSPQPWHAPWNPRPLASLVAIFHKYSGREGDKHTLSKKELKELIQKELTIGSKLQDAEIARLMEDLDRNKDQEVNFQEYVTFLGALALIYNDSPQGLEK

SEQ ID NO: 851609 - protein, 118 aa, Homo sapiens
RPRVARGVGRIWPPPYRSKPSPQPWHAPWNPRPLASLVAIFHKYSGREGDKHTLSKKELKELIQKELTIGSKLQDAEIARLMEDLDRNKDQEVNFQEYVTFLGALALIYNDSPQGLEK

SEQ ID NO: 851610 - protein, 150 aa, Homo sapiens
RKLSKLSCADEGRLVTRRAVGTAGLPHPVLTRNSPGQEAWKVEGVNRECSKPSPQPWHAPWNPRPLASLVAIFHKYSGREGDKHTLSKKELKELIQKELTIGSKLQDAEIARLMEDLDRNKDQEVNFQEYVTFLGALALIYNDSPQGLEK

SEQ ID NO: 851611 - protein, 116 aa, Homo sapiens
SCRIRHERIWPPPYRSKPSPQPWHAPWNPRPLASLVAIFHKYSGREGDKHTLSKKELKELIQKELTIGSKLQDAEIARLMEDLDRNKDQEVNFQEYVTFLGALALIYNDSPQGLEK

SEQ ID NO: 851612 - protein, 128 aa, Homo sapiens
VLRTSDDFGAKAGAVATKVDMRAPPYRSKPSPQPWHAPWNPRPLASLVAIFHKYSGREGDKHTLSKKELKELIQKELTIGSKLQDAEIARLMEDLDRNKDQEVNFQEYVTFLGALALIYNDSPQGLEK

SEQ ID NO: 851613 - protein, 206 aa, Homo sapiens
RKLSKLSCADEGRLVTRRAVGTAGLPHPVLTRNSPGQEAWKVEGVNRECALCKPRRRVGRGRDLGGRGGLGRAGLRGTDRYKASRTATQPIPSTARVAFGRLPTGSKPSPQPWHAPWNPRPLASLVAIFHKYSGREGDKHTLSKKELKELIQKELTIGSKLQDAEIARLMEDLDRNKDQEVNFQEYVTFLGALALIYNDSPQGLEK

SEQ ID NO: 851614 - protein, 206 aa, Homo sapiens; identical to SEQ ID NO: 851613

SEQ ID NO: 851615 - protein, 99 aa, Homo sapiens
GRLLLLNSRPRRRPLASLVAIFHKYSGREGDKHTLSKKELKELIQKELTIGSKLQDAEIARLMEDLDRNKDQEVNFQEYVTFLGALALIYNDSPQGLEK

SEQ ID NO: 851616 - protein, 125 aa, Homo sapiens
MSNPLLCSDPPSTARVAFGRLPTGSKPSPQPWHAPWNPRPLASLVAIFHKYSGREGDKHTLSKKELKELIQKELTIGSKLQDAEIARLMEDLDRNKDQEVNFQEYVTFLGALALIYNDSPQGLEK

SEQ ID NO: 851617 - protein, 136 aa, Homo sapiens
KEKARYEAGGNRHRGDCDTAHPLDRSRRIWPPPYRSKPSPQPWHAPWNPRPLASLVAIFHKYSGREGDKHTLSKKELKELIQKELTIGSKLQDAEIARLMEDLDRNKDQEVNFQEYVTFLGALALIYNDSPQGLEK

SEQ ID NO: 851618 - protein, 116 aa, Homo sapiens; identical to SEQ ID NO: 851611

SEQ ID NO: 851619 - protein, 128 aa, Homo sapiens; identical to SEQ ID NO: 851612

SEQ ID NO: 851620 - protein, 132 aa, Homo sapiens
MEGLYWTVQVGAVDGTPSVDRSRRIWPPPYRSKPSPQPWHAPWNPRPLASLVAIFHKYSGREGDKHTLSKKELKELIQKELTIGSKLQDAEIARLMEDLDRNKDQEVNFQEYVTFLGALALIYNDSPQGLEK

SEQ ID NO: 851621 - protein, 309 aa, Homo sapiens
KEKARYEAGGNRHRGDCDTAHPLDRSRRIWPPPYRSKPSPQPWHAPWNPRPLASLVAIFHKYSGREGDKHTLSKKELKELIQKELTIGSKLQDAEIARLMEDLDRNYMDLECESSMEYVILPGGPLALLQVKALNGLKHNSEGYMADSPLAGPLSQKSMWLALIVASRHLLCFVSRVVTDNHNINIDDSSTLKHTNQRQEDIQCGAGDPETGAPPEARANFDRAMQPGFVCEAIEVGRAPTHEGSGASLKITGERADRSAPEHAKHSIGRGVGKIRRRQEERAYGRGKGTDGGGPGGGDPLLGRKNHPP

SEQ ID NO: 851622 - protein, 111 aa, Homo sapiens
MALTRPSAASSKPSPQPWHAPWNPRPLASLVAIFHKYSGREGDKHTLSKKELKELIQKELTIGSKLQDAEIARLMEDLDRNKDQEVNFQEYVTFLGALALIYNDSPQGLEK

SEQ ID NO: 851623 - protein, 181 aa, Homo sapiens
NTLCLTHSYVLTHPRPLASHLAASLPVSSLQEPWVLSRASCPHAGGPAIPCPVQPLDPDWGHLWRSPAGGIVRSSSAVPGSKPSPQPWHAPWNPRPLASLVAIFHKYSGREGDKHTLSKKELKELIQKELTIGSKLQDAEIARLMEDLDRNKDQEVNFQEYVTFLGALALIYNDSPQGLEK

SEQ ID NO: 851624 - protein, 111 aa, Homo sapiens; identical to SEQ ID NO: 851622

SEQ ID NO: 851625 - protein, 132 aa, Homo sapiens; identical to SEQ ID NO: 851620

SEQ ID NO: 851626 - protein, 206 aa, Homo sapiens; identical to SEQ ID NO: 851613

SEQ ID NO: 851627 - protein, 206 aa, Homo sapiens; identical to SEQ ID NO: 851613

SEQ ID NO: 851628 - protein, 206 aa, Homo sapiens; identical to SEQ ID NO: 851613

SEQ ID NO: 851629 - protein, 206 aa, Homo sapiens; identical to SEQ ID NO: 851613

SEQ ID NO: 851630 - protein, 206 aa, Homo sapiens; identical to SEQ ID NO: 851613

SEQ ID NO: 851631 - protein, 206 aa, Homo sapiens; identical to SEQ ID NO: 851613

SEQ ID NO: 851632 - protein, 111 aa, Homo sapiens; identical to SEQ ID NO: 851622

SEQ ID NO: 851633 - protein, 79 aa, Homo sapiens
YTTLYHRTIPPKHTLSKKELKELIQKELTIGSKLQDAEIARLMEDLDRNKDQEVNFQEYVTFLGALALIYNDSPQGLEK

SEQ ID NO: 851634 - protein, 81 aa, Homo sapiens
RPPTTTKFAAASTKHTLSKKELKELIQKELTIGSKLQDAEIARLMEDLDRNKDQEVNFQEYVTFLGALALIYNDSPQGLEK

SEQ ID NO: 851635 - protein, 122 aa, Homo sapiens
RPPTTTKFAAASTAFGRLPYRSKPSPQPWHAPWNPRPLASLVAIFHKYSGREGDKHTLSKKELKELIQKELTIGSKLQDAEIARLMEDLDRNKDQEVNFQEYVTFLGALALIYNDSPQGLEK

SEQ ID NO: 851636 - protein, 306 aa, Homo sapiens
RKLSKLSCADEGRLVTRRAVGTAGLPHPVLTRNSPGQEAWKVEGVNRECALCKPRRRVGRGRDLGGRGGLGRAGLRGTDRYKASRTATQPIPSTARVAFGRLPTGSKPSPQPWHAPWNPRPLASLVAIFHKYSGREGDKHTLSKKELKELIQKELTIGSKLQDAEIARLMEDLDRNNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLNL

SEQ ID NO: 851637 - protein, 206 aa, Homo sapiens; identical to SEQ ID NO: 851613

SEQ ID NO: 851638 - protein, 120 aa, Homo sapiens
AAAYYYYYCSNSASNDVRGSKPSPQPWHAPWNPRPLASLVAIFHKYSGREGDKHTLSKKELKELIQKELTIGSKLQDAEIARLMEDLDRNKDQEVNFQEYVTFLGALALIYNDSPQGLEK

SEQ ID NO: 851639 - protein, 105 aa, Homo sapiens
MVSPLPRPDSATWWPPGYRPLASLVAIFHKYSGREGDKHTLSKKELKELIQKELTIGSKLQDAEIARLMEDLDRNKDQEVNFQEYVTFLGALALIYNDSPQGLEK

SEQ ID NO: 851640 - protein, 118 aa, Homo sapiens; identical to SEQ ID NO: 851609

SEQ ID NO: 851641 - protein, 129 aa, Homo sapiens; identical to SEQ ID NO: 851608

SEQ ID NO: 851642 - protein, 132 aa, Homo sapiens; identical to SEQ ID NO: 851620

SEQ ID NO: 851643 - protein, 144 aa, Homo sapiens
MASCPHAGGPAIPCPVQPLDPDWGHLWRSPAGGIVRSSSAVPGSKPSPQPWHAPWNPRPLASLVAIFHKYSGREGDKHTLSKKELKELIQKELTIGSKLQDAEIARLMEDLDRNKDQEVNFQEYVTFLGALALIYNDSPQGLEK

SEQ ID NO: 851644 - protein, 118 aa, Homo sapiens
MSEYTRRSRRIWPPPYRSKPSPQPWHAPWNPRPLASLVAIFHKYSGREGDKHTLSKKELKELIQKELTIGSKLQDAEIARLMEDLDRNKDQEVNFQEYVTFLGALALIYNDSPQGLEK

SEQ ID NO: 851645 - protein, 122 aa, Homo sapiens; identical to SEQ ID NO: 851635

SEQ ID NO: 851646 - protein, 206 aa, Homo sapiens; identical to SEQ ID NO: 851613

SEQ ID NO: 851647 - protein, 206 aa, Homo sapiens; identical to SEQ ID NO: 851613

SEQ ID NO: 851648 - protein, 206 aa, Homo sapiens; identical to SEQ ID NO: 851613

SEQ ID NO: 851649 - protein, 206 aa, Homo sapiens; identical to SEQ ID NO: 851613

SEQ ID NO: 851650 - protein, 206 aa, Homo sapiens; identical to SEQ ID NO: 851613

SEQ ID NO: 851651 - protein, 85 aa, Homo sapiens
LADSEQDPSLYSGREGDKHTLSKKELKELIQKELTIGSKLQDAEIARLMEDLDRNKDQEVNFQEYVTFLGALALIYNDSPQGLEK

SEQ ID NO: 851652 - protein, 144 aa, Homo sapiens; identical to SEQ ID NO: 851643

SEQ ID NO: 851653 - protein, 150 aa, Homo sapiens; identical to SEQ ID NO: 851610

SEQ ID NO: 851654 - protein, 162 aa, Homo sapiens
RKLSKLSCADEGRLVTRRAVGTAGLPHPVLTRNSPGQEAWKVEGVNRECALCKPRRRVGRGRDLGGRGGLGRAGLRGTDRYKASRTATQPIPSTARVAFGRLPTGEFSPGALGTFQGQLPSRWGSSHPLPSSAAGSRLGPSVALPRWRDSQEQQCCARQALG

SEQ ID NO: 851655 - protein, 175 aa, Homo sapiens
SWYARVRDDNPGVPGNAGPPSHIIGDEEIPENCLEQLEMGFPRGAQPAPLLCSVLKASGSLQQLSLDSATFASPQDFGLVLQTLKEYNLALKRLSFHDMNLADCQSEVLFLLQNLTLQEITFSFCRLFEKRPAQFLPEMVAAMKGNSTLKGLRLPGNRLGGGQTLGRERGKELGL

SEQ ID NO: 851656 - protein, 731 aa, Homo sapiens [sequence omitted]

SEQ ID NO: 851657 - protein, 817 aa, Homo sapiens
AHLPKMAAPEAWRARSCWFCEVAAATTMEATSREAAPAKSSASGPNAPPALFELCGRAVSAHMGVLESGVWALPGPILQSILPLLNIYYLERIEETALKKGLSTQAIWRRLWDELMKTRPSSLESVTCWRAKFMEAFFSHVLRGTIDVSSDRRLCDQRFSPLLHSSRHVRQLTICNMLQGATELVAEPNRRVLETLASSLHTLKFRHLLFSDVAAQQSLRQLLHQLIHHGAVSQVSLYSWPVPESALFILILTMSAGFWQPGPGGPPCRLCGEASRGRAPSRDEGSLLLGSRRPRRDAAERCAAALMASRRKSEAKQMPRAAPATRVTRRSTQESLTAGGTDLKRELHPPATSHEAPGTKRSPSAPAATSSASSSTSSYKRAPASSAPQPKPLKRFKRAAGKKGARTRQGPGAESEDLYDFVFIVAGEKEDGEEMEIGEVACGALDGSDPSCLGLPALEASQRFRSISTLELFTVPLSTEAALTLCHLLSSWVSLESLTLSYNGLGSNIFRLLDSLRALSGQAGCRLRALHLSDLFSPLPILELTRAIVRALPLLRVLSIRVDHPSQRDNPGVPGNAGPPSHIIGDEEIPENCLEQLEMGFPRGAQPAPLLCSVLKASGSLQQLSLDSATFASPQDFGLVLQTLKEYNLALKRLSFHDMNLADCQSEVLFLLQNLTLQEITFSFCRLFEKRPAQFLPEMVAAMKGNSTLKGLRLPGNRLGNAGLLALADVFSEDSSSSLCQLDISSNCIKPDGLLEFAKRLERWGRGAFGHLRLFQNWLDQDAVTAREAIRRLRATCHVVSDSWDSSQAFADYVSTM

SEQ ID NO: 851658 - protein, 817 aa, Homo sapiens; identical to SEQ ID NO: 851657

SEQ ID NO: 851659 - protein, 811 aa, Homo sapiens
AHLPKMAAPEAWRARSCWFCEVAAATTMEATSREAAPAKSSASGPNAPPALFELCGRAVSAHMGVLESGVWALPGPILQSILPLLNIYYLERIEETALKKGLSTQAIWRRLWDELMKTRPSSLESVTCWRAKFMEAFFSHVLRGTIDVSSDRRLCDQRFSPLLHSSRHVRQLTICNMLQGATELVAEPNRRVLETLASSLHTLKFRHLLFSDVAAQQSLRQLLHQLIHHGAVSQVSLYSWPVPESALFILILTMSAGFWQPGPGGPPCRLCGEASRDEGSLLLGSRRPRRDAAERCAAALMASRRKSEAKQMPRAAPATRVTRRSTQESLTAGGTDLKRELHPPATSHEAPGTKRSPSAPAATSSASSSTSSYKRAPASSAPQPKPLKRFKRAAGKKGARTRQGPGAESEDLYDFVFIVAGEKEDGEEMEIGEVACGALDGSDPSCLGLPALEASQRFRSISTLELFTVPLSTEAALTLCHLLSSWVSLESLTLSYNGLGSNIFRLLDSLRALSGQAGCRLRALHLSDLFSPLPILELTRAIVRALPLLRVLSIRVDHPSQRDNPGVPGNAGPPSHIIGDEEIPENCLEQLEMGFPRGAQPAPLLCSVLKASGSLQQLSLDSATFASPQDFGLVLQTLKEYNLALKRLSFHDMNLADCQSEVLFLLQNLTLQEITFSFCRLFEKRPAQFLPEMVAAMKGNSTLKGLRLPGNRLGNAGLLALADVFSEDSSSSLCQLDISSNCIKPDGLLEFAKRLERWGRGAFGHLRLFQNWLDQDAVTAREAIRRLRATCHVVSDSWDSSQAFADYVSTM

SEQ ID NO: 851660 - protein, 530 aa, Homo sapiens
PQMGPLFLNCHHCTDKATWVAGTLWSVRGQRGEGLHTKTALSSRRGKAAAEENPVGLAVLDEEKEGVVGAEAGDESGTPHHHDGSCGGCSLRAFLIDLHKRLVHDLGQRQVCLGHSREVCLAQLEGISHAQVAQDTLHVVAFLYFKPREGHFHLLFIHHVQPRPFYELLVSEFFLHRSQVSGLVRKHDDHIQFLANIWKHQDLGKYFSYIGLLKSRLLKHHLHRFLLILADFKQSLLGVLLVKLFIPVSSEIDSIALTRAIVRALPLLRVLSIRVDHPSQRDNPGVPGNAGPPSHIIGDEEIPENCLEQLEMGFPRGAQPAPLLCSVLKASGSLQQLSLDSATFASPQDFGLVLQTLKEYNLALKRLSFHDMNLADCQSEVLFLLQNLTLQEITFSFCRLFEKRPAQFLPEMVAAMKGNSTLKGLRLPGNRLGNAGLLALADVFSEDSSSSLCQLDISSNCIKPDGLLEFAKRLERWGRGAFGHLRLFQNWLDQDAVTAREAIRRLRATCHVVSDSWDSSQAFADYVSTM

SEQ ID NO: 851661 - protein, 548 aa, Homo sapiens
AHLPKMAAPEAWRARSCWFCEVAAATTMEATSREAAPAKSSASGPNAPPALFELCGRAVSAHMGVLESGVWALPGPILQSILPLLNIYYLERIEETALKKGLSTQAIWRRLWDELMKTRPSSLESVTCWRAKFMEAFFSHVLRGTIDVSSDRRLCDQRFSPLLHSSRHVRQLTICNMLQGATELVAEPNRRVLETLASSLHTLKFRHLLFSDVAAQQSLRQLLHQLIHHGAVSQVSLYSWPVPESALFILILTMSAGFWQPGPGGPPCRLCGEASRGRAPSRDEGSLLLGSRRPRRDAAERCAAALMASRRKSEAKQMPRAAPATRVTRRSTQESLTAGGTDLKRELHPPATSHEAPGTKRSPSAPAATSSASSSTSSYKRAPASSAPQPKPLKRFKRAAGKKGARTRQGPGAESEDLYDFVFIVAGEKEDGEEMEIGEVACGALDGSDPSCLGLPALEASQRFRSISTLELFTVPLSTEAALTLCHLLSSWVSLESLTLSYNGEHPGVAGIGLRLPSSTSCVPNSREVGGANWGYDQEVREEGLYAS

SEQ ID NO: 851662 - protein, 548 aa, Homo sapiens; identical to SEQ ID NO: 851661

SEQ ID NO: 851663 - protein, 110 aa, Homo sapiens
PGQREGFGENWPWLGLWKNVFFKRNSSLLLMSRWEHQVSNCIKPDGLLEFAKRLERWGRGAFGHLRLFQNWLDQDAVTAREAIRRLRATCHVVSDSWDSSQAFADYVSTM

SEQ ID NO: 851664 - protein, 817 aa, Homo sapiens; identical to SEQ ID NO: 851657

SEQ ID NO: 851665 - protein, 707 aa, Homo sapiens
MDISWLSGMFSAFQSVTCWRAKFMEAFFSHVLRGTIDVSSDRRLCDQRFSPLLHSSRHVRQLTICNMLQGATELVAEPNRRVLETLASSLHTLKFRHLLFSDVAAQQSLRQLLHQLIHHGAVSQVSLYSWPVPESALFILILTMSAGFWQPGPGGPPCRLCGEASRGRAPSRDEGSLLLGSRRPRRDAAERCAAALMASRRKSEAKQMPRAAPATRVTRRSTQESLTAGGTDLKRELHPPATSHEAPGTKRSPSAPAATSSASSSTSSYKRAPASSAPQPKPLKRFKRAAGKKGARTRQGPGAESEDLYDFVFIVAGEKEDGEEMEIGEVACGALDGSDPSCLGLPALEASQRFRSISTLELFTVPLSTEAALTLCHLLSSWVSLESLTLSYNGLGSNIFRLLDSLRALSGQAGCRLRALHLSDLFSPLPILELTRAIVRALPLLRVLSIRVDHPSQRDNPGVPGNAGPPSHIIGDEEIPENCLEQLEMGFPRGAQPAPLLCSVLKASGSLQQLSLDSATFASPQDFGLVLQTLKEYNLALKRLSFHDMNLADCQSEVLFLLQNLTLQEITFSFCRLFEKRPAQFLPEMVAAMKGNSTLKGLRLPGNRLGNAGLLALADVFSEDSSSSLCQLDISSNCIKPDGLLEFAKRLERWGRGAFGHLRLFQNWLDQDAVTAREAIRRLRATCHVVSDSWDSSQAFADYVSTM

SEQ ID NO: 851666 - protein, 701 aa, Homo sapiens
RDLRPRLESVTCWRAKFMEAFFSHVLRGTIDVSSDRRLCDQRFSPLLHSSRHVRQLTICNMLQGATELVAEPNRRVLETLASSLHTLKFRHLLFSDVAAQQSLRQLLHQLIHHGAVSQVSLYSWPVPESALFILILTMSAGFWQPGPGGPPCRLCGEASRGRAPSRDEGSLLLGSRRPRRDAAERCAAALMASRRKSEAKQMPRAAPATRVTRRSTQESLTAGGTDLKRELHPPATSHEAPGTKRSPSAPAATSSASSSTSSYKRAPASSAPQPKPLKRFKRAAGKKGARTRQGPGAESEDLYDFVFIVAGEKEDGEEMEIGEVACGALDGSDPSCLGLPALEASQRFRSISTLELFTVPLSTEAALTLCHLLSSWVSLESLTLSYNGLGSNIFRLLDSLRALSGQAGCRLRALHLSDLFSPLPILELTRAIVRALPLLRVLSIRVDHPSQRDNPGVPGNAGPPSHIIGDEEIPENCLEQLEMGFPRGAQPAPLLCSVLKASGSLQQLSLDSATFASPQDFGLVLQTLKEYNLALKRLSFHDMNLADCQSEVLFLLQNLTLQEITFSFCRLFEKRPAQFLPEMVAAMKGNSTLKGLRLPGNRLGNAGLLALADVFSEDSSSSLCQLDISSNCIKPDGLLEFAKRLERWGRGAFGHLRLFQNWLDQDAVTAREAIRRLRATCHVVSDSWDSSQAFADYVSTM

SEQ ID NO: 851667 - protein, 817 aa, Homo sapiens; identical to SEQ ID NO: 851657

SEQ ID NO: 851668 - protein, 697 aa, Homo sapiens
AHLPKMAAPEAWRARSCWFCEVAAATTMEATSREAAPAKSSASGPNAPPALFELCGRAVSAHMGVLESGVWALPGPILQSILPLLNIYYLERIEETALKKGLSTQAIWRRLWDELMKTRPSSLESVTCWRAKFMEAFFSHVLRGTIDVSSDRRLCDQRFSPLLHSSRHVRQLTICNMLQGATELVAEPNRRVLETLASSLHTLKFRHLLFSDVAAQQSLRQLLHQLIHHGAVSQVSLYSWPVPESALFILILTMSAGFWQPGPGGPPCRLCGEASRGRAPSRDEGSLLLGSRRPRRDAAERCAAALMASRRKSEAKQMPRAAPATRVTRRSTQESLTAGGTDLKRELHPPATSHEAPGTKRSPSAPAATSSASSSTSSYKRAPASSAPQPKPLKRFKRAAGKKGARTRQGPGAESEDLYDFVFIVAGEKEDGEEMEIGEVACGALDGSDPSCLGLPALEASQRFRSISTLELFTVPLSTEAALTLCHLLSSWVSLESLTLSYNGLGSNIFRLLDSLRALSGQAGCRLRALHLSDLFSPLPILELTRAIVRALPLLRVLSIRVDHPSQRDNPGVPGNAGPPSHIIGDEEIPENCLEQLEMGFPRGAQPAPLLCSVLKASGSLQQLSLDSATFASPQDFGLVLQTLKEYNLALKRLSFHDMNLADCQSEVLFLLQNLTLQGKFLIQNLDISWVFTMVLP

SEQ ID NO: 851669 - protein, 799 aa, Homo sapiens
AHLPKMAAPEAWRARSCWFCEVAAATTMEATSREAAPAKSSASGPNAPPALFELCGRAVSAHMGVLESGVWALPGPILQSILPLLNIYYLERIEETALKKGLSTQAIWRRLWDELMKTRPSSLESVTCWRAKFMEAFFSHVLRGTIDVSSDRRLCDQRFSPLLHSSRHVRQLTICNMLQGATELVAEPNRRVLETLASSLHTLKFRHLLFSDVAAQQSLRQLLHQLIHHGAVSQVSLYSWPVPESALFILILTMSAGFWQPGPGGPPCRLCGEASRGRAPSRDEGSLLLGSRRPRRDAAERCAAALMASRRKSEAKQMPRAAPATRVTRRSTQESLTAGGTDLKRELHPPATSHEAPGTKRSPSAPAATSSASSSTSSYKRAPASSAPQPKPLKRFKRAAGKKGARTRQGPGAESEDLYDFVFIVAGEKEDGEEMEIGEVACGALDGSDPSCLGLPALEASQRFRSISTLELFTVPLSTEAALTLCHLLSSWVSLESLTLSYNGLGSNIFRLLDSLRALSGQAGCRLRALHLSDLFSPLPILELTRAIVRALPLLRVLSIRVDHPSQRDNPGVPGNAGPPSHIIGDEEIPENCLEQLEMGFPRGAQPAPLLCSVLKASGSLQQLSLDSATFASPQDFGLVLQTLKEYNLALKRLSFHDMNLADCQSEVLFLLQNLTLQEITFSFCRLFEKRPAQFLPEMVAAMKGNSTLKGLRLPGNRLGNAGLLALADVFSEDSSSSLCQLDISSNCIKPDGLLEFAKRLERWGRGAFGHLRLFRATCHVVSDSWDSSQAFADYVSTM

SEQ ID NO: 851670 - protein, 817 aa, Homo sapiens; identical to SEQ ID NO: 851657

SEQ ID NO: 851671 - protein, 679 aa, Homo sapiens
AHLPKMAAPEAWRARSCWFCEVAAATTMEATSREAAPAKSSASGPNAPPALFELCGRAVSAHMGVLESGVWALPGPILQSILPLLNIYYLERIEETALKKGLSTQAIWRRLWDELMKTRPSSLESVTCWRAKFMEAFFSHVLRGTIDVSSDRRLCDQRFSPLLHSSRHVRQLTICNMLQGATELVAEPNRRVLETLASSLHTLKFRHLLFSDVAAQQSLRQLLHQLIHHGAVSQVSLYSWPVPESALFILILTMSAGFWQPGPGGPPCRLCGEASRGRAPSRDEGSLLLGSRRPRRDAAERCAAALMASRRKSEAKQMPRAAPATRVTRRSTQESLTAGGTDLKRELHPPATSHEAPGTKRSPSAPAATSSASSSTSSYKRAPASSAPQPKPLKRFKRAAGKKGARTRQGPGAESEDLYDFVFIVAGEKEDGEEMEIGEVACGALDGSDPSCLGLPALEASQRFRSISTLELFTVPLSTEAALTLCHLLSSWVSLESLTLSYNGLGSNIFRLLDSLRALSGQAGCRLRALHLSDLFSPLPILELTRAIVRALPLLRVLSIRVDHPSQRDNPGVPGNAGPPSHIIGDEEIPENCLEQLEMGFPRGAQPAPLLCSVLKASGSLQQLSLDSATFASPQDFGPLLSILGTLGQEVTVVIIIAEEIPSPAPGFLPSLLKQAPRL

SEQ ID NO: 851672 - protein, 680 aa, Homo sapiens
AHLPKMAAPEAWRARSCWFCEVAAATTMEATSREAAPAKSSASGPNAPPALFELCGRAVSAHMGVLESGVWALPGPILQSILPLLNIYYLERIEETALKKGLSTQAIWRRLWDELMKTRPSSLESVTCWRAKFMEAFFSHVLRGTIDVSSDRRLCDQRFSPLLHSSRHVRQLTICNMLQGATELVAEPNRRVLETLASSLHTLKFRHLLFSDVAAQQSLRQLLHQLIHHGAVSQVSLYSWPVPESALFILILTMSAGFWQPGPGGPPCRLCGEASRGRAPSRDEGSLLLGSRRPRRDAAERCAAALMASRRKSEAKQMPRAAPATRVTRRSTQESLTAGGTDLKRELHPPATSHEAPGTKRSPSAPAATSSASSSTSSYKRAPASSAPQPKPLKRFKRAAGKKGARTRQGPGAESEDLYDFVFIVAGEKEDGEEMEIGEVACGALDGSDPSCLGLPALEASQRFRSISTLELFTVPLSTEAALTLCHLLSSWVSLESLTLSYNGLGSNIFRLLDSLRALSGQAGCRLRALHLSDLFSPLPILELTRAIVRALPLLRVLSIRVDHPSQRDNPGVPGNAGPPSHIIGDEEIPEYNLALKRLSFHDMNLADCQSEVLFLLQNLTLQEITFSFCRLFEKRPAQFLPEMVAAMKGNSTLKGLRLPGNRLGGGQTLGRERGKELGL

SEQ ID NO: 851673 - protein, 270 aa, Homo sapiens
AHLPKMAAPEAWRARSCWFCEVAAATTMEATSREAAPAKSSASGPNAPPALFELCGRAVSAHMGVLESGVWALPGPILQSILPLLNIYYLERIEETALKKGLSTQAIWRRLWDELMKTRPSSLESVTCWRAKFMEAFFSHVLRGTIDVSSDRRLCDQRFSPLLHSSRHVRQLTICNMLQGATELVAEPNRRVLETLASSLHTLKFRHLLFSDVAAQQSLRQLLHQLIHHGAVSQVSLYSWPVPESALFILILTTSLYAILINCYLLFFTN

SEQ ID NO: 851674 - protein, 452 aa, Homo sapiens
MSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEEKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQQLKILADSINSEIGILCSALQKIK

SEQ ID NO: 851675 - protein, 80 aa, Homo sapiens
GRRGCGRGKETGCGRQEGLLGLRLGLLAGAAALHLGRAFHAQRRPRSRGIRAIRDARCGAREGDTERTWVQEQRGKEKEI

SEQ ID NO: 851676 - protein, 430 aa, Homo sapiens
MSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEEKKTWGTVFKTLKSLYKTHACYEYNHIFPLLACTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQQLKILADSINSEIGILCSALQKIK

SEQ ID NO: 851677 - protein, 439 aa, Homo sapiens
MSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEEKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATGDSIKAYGAGLLSSFGELQYCLSEKPKLLPLELEKTAIQNYTVTEFQPLYYVAESFNDAKEKVRNFAATIPRPFSVRYDPYTQRIEVLDNTQQLKILADSINSEIGILCSALQKIK

SEQ ID NO: 851678 - protein, 434 aa, Homo sapiens
MSTAVLENPGLGRKLSDFGQETSYIEDNCNPKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEEKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQQLKILADSINSEIGILCSALQKIK

SEQ ID NO: 851679 - protein, 229 aa, Homo sapiens
MSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEEKKTWGTVFKTLKSLYKSTVASMKITFPSWKTFLSSCRLALVSASDL

SEQ ID NO: 851680 - protein, 452 aa, Homo sapiens; identical to SEQ ID NO: 851674

SEQ ID NO: 851681 - protein, 344 aa, Homo sapiens
MTLVPLSMSFHEIRRTIQELDRFANQILSYGAELDADHPGFKDPVYRARRKQFADIAYNYRHGQPIPRVEYMEEEKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQQLKILADSINSEIGILCSALQKIK

SEQ ID NO: 851682 - protein, 177 aa, Homo sapiens [sequence omitted]

SEQ ID NO: 851683 - protein, 452 aa, Homo sapiens; identical to SEQ ID NO: 851674

SEQ ID NO: 851684 - protein, 452 aa, Homo sapiens; identical to SEQ ID NO: 851674

SEQ ID NO: 851685 - protein, 199 aa, Homo sapiens
MGRKDLITHSGSMWAVLKASGHPSPFYGQVLGWFCGSNYRNRTGSIFPQLQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQQLKILADSINSEIGILCSALQKIK

SEQ ID NO: 851686 - protein, 199 aa, Homo sapiens; identical to SEQ ID NO: 851685

SEQ ID NO: 851687 - protein, 267 aa, Homo sapiens [sequence omitted]

SEQ ID NO: 851688 - protein, 136 aa, Homo sapiens
MSTAVLENPGLGRKLSDFGQETSYIEDNCNPKVLRLFEENDVNLTHIESRPSRLKKDEYEFFTHLDKRSLPALTNIIKILRHDIGATVHELSRDKKKDTVPWFPRTIQELDRFANQILSYGAELDADHPVSPWPVG

SEQ ID NO: 851689 - protein, 452 aa, Homo sapiens; identical to SEQ ID NO: 851674

SEQ ID NO: 851690 - protein, 105 aa, Homo sapiens
MQLLPHHPNTPAAVDAWHGQRICVLRTHPGRKKKNPNNLEGRAPPPWEEHLGRGMSPEQGTRSKEHPEGGEPSPGGSRGAHTNSGRGHQKIFGVSSPRHKGARDL

SEQ ID NO: 851691 - protein, 452 aa, Homo sapiens; identical to SEQ ID NO: 851674

SEQ ID NO: 851692 - protein, 452 aa, Homo sapiens; identical to SEQ ID NO: 851674

SEQ ID NO: 851693 - protein, 434 aa, Homo sapiens
MSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEEKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIHDAKEKVRNFAATIPRPFSVRYDPYTQRIEVLDNTQQLKILADSINSEIGILCSALQKIK

SEQ ID NO: 851694 - protein, 452 aa, Homo sapiens; identical to SEQ ID NO: 851674

SEQ ID NO: 851695 - protein, 471 aa, Homo sapiens
GCRIRHELKSQRPHSRGASMSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEEKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQQLKILADSINSEIGILCSALQKIK

SEQ ID NO: 851696 - protein, 452 aa, Homo sapiens; identical to SEQ ID NO: 851674

SEQ ID NO: 851697 - protein, 412 aa, Homo sapiens
MSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEEKKTWGTVFKTLKSLYKTHACYEYNHIFPLLACTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIHDAKEKVRNFAATIPRPFSVRYDPYTQRIEVLDNTQQLKILADSINSEIGILCSALQKIK

SEQ ID NO: 851698 - protein, 452 aa, Homo sapiens; identical to SEQ ID NO: 851674

SEQ ID NO: 851699 - protein, 281 aa, Homo sapiens
MSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEEKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEP

SEQ ID NO: 851700 - protein, 154 aa, Homo sapiens
MSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPVSPWPVG

SEQ ID NO: 851701 - protein, 293 aa, Homo sapiens
MNPFWSMSTSSVRKRSEGEEKTLTGDVKTSPPRTAPKKQLPSIPKNALPITKPTSPAPAAQSTNGTHASYGPFYLEYSLLAEFTLVVKQKLPGVYVQPSYRSALMWFGVIFIRHGLYQDGVFKFTVYIPDNYPDGDCPRLVFDIPVFHPLVDPTSGELDVKRAFAKWRRNHNHIWQVLMYARRVFYKIDTASPLNPEAAVLYEKDIQLFKSKVVDSVKVCTARLFDQPKIEDPYAISFSPWNPSVHDEAREKMLTQKKKPEEQHNKSVHVAGLSWVKPGSVQPFSKEEKTVAT

SEQ ID NO: 851702 - protein, 205 aa, Homo sapiens
MNPFWSMSTSSVRKRSEGEEKTLTGDVKTSPPRTAPKKQLPSIPKNALPITKPTSPAPAAQSTNGTHASYGPFYLEYSLLAEFTLVVKQKLPGVYVQPSYRSALMWFGVIFIRHGLYQDGVFKFTVYIPDNYPDGDCPRLVFDIPVFHPLVDPTSGELDVKRAFAKWRGGTIDHIWRVLCLPRGSYRVRYEAPEPKLSLVERFPF

SEQ ID NO: 851703 - protein, 293 aa, Homo sapiens; identical to SEQ ID NO: 851701

SEQ ID NO: 851704 - protein, 293 aa, Homo sapiens; identical to SEQ ID NO: 851701

SEQ ID NO: 851705 - protein, 293 aa, Homo sapiens; identical to SEQ ID NO: 851701

SEQ ID NO: 851706 - protein, 293 aa, Homo sapiens; identical to SEQ ID NO: 851701

SEQ ID NO: 851707 - protein, 332 aa, Homo sapiens
MNPFWSMSTSSVRKRSEGEEKTLTGDVKTSPPRTAPKKQLPSIPKNALPITKPTSPAPAAQSTNGTHASYGPFYLEYSLLAEFTLVVKQKLPGVYVQPSYRSALMWFGVIFIRHGLYQDGVFKFTVYIPDNYPDGDCPLSRGTSVLCSSFRHAIRALFLCSGSAREAGCLPSCSTHQRLVFDIPVFHPLVDPTSGELDVKRAFAKWRRNHNHIWQVLMYARRVFYKIDTASPLNPEAAVLYEKDIQLFKSKVVDSVKVCTARLFDQPKIEDPYAISFSPWNPSVHDEAREKMLTQKKKPEEQHNKSVHVAGLSWVKPGSVQPFSKEEKTVAT

SEQ ID NO: 851708 - protein, 260 aa, Homo sapiens
MNPFWSMSTSSVRKRSEGEEKTLTGDVKTSPPRTAPKKQLPSIPKNALPITKPTSPAPAAQSTNGTHASYGPFYLEYSLLAEFTLVVKQKLPGVYVQPSYRSALMWFGVIFIRHGLYQDGVFKFTVYIPDNYPDGDCPRLVFDIPVFHPLVDPTSGELDVKRAFAKWRYEKDIQLFKSKVVDSVKVCTARLFDQPKIEDPYAISFSPWNPSVHDEAREKMLTQKKKPEEQHNKSVHVAGLSWVKPGSVQPFSKEEKTVAT

SEQ ID NO: 851709 - protein, 171 aa, Homo sapiens
MNPFWSMSTSSVRKRSEGEEKTLTGDVKTSPPRTAPKKQLPSIPKNALPITKPTSPAPAAQSTNGTHASYGPFYLEYSLLAEFTLVVKQKLPGVYVQPSYRSALMWFGVIFIRHGLYQDGVFKFTVYIPDNYPDGDCPRLVFDIPVFHPLVDPTSGELDVKRAFAKWRVSK

SEQ ID NO: 851710 - protein, 293 aa, Homo sapiens; identical to SEQ ID NO: 851701

SEQ ID NO: 851711 - protein, 122 aa, Homo sapiens
RPQWDTEAGPGTCARLQAPAALAASQPGTAAGDCGWSWAGPARGRGGPSWLAPARARPPRPGPDPELWLRGRRRAPEPPHWRGPRLPGQHRASCEARTGPPPCITSRQVCPDSLSAQRRVSA

SEQ ID NO: 851712 - protein, 105 aa, Homo sapiens
MFLGVPRLIGIRLTLPPPKVVDRWNEKRAMFGVYDNIGILGNFEKHPKELIRGPIWLRGWKGNELQRCIRKRKMVGSRMFADDLHNLNKRIRYLYKHFNRHGKFR

SEQ ID NO: 851713 - protein, 128 aa, Homo sapiens
MAGNLLSGAGRRLWDWVPLACRSFSLGVPRLIGIRLTLPPPKVVDRWNEKRAMFGVYDNIGILGNFEKHPKELIRGPIWLRGWKGNELQRCIRKRKMVGSRMFADDLHNLNKRIRYLYKHFNRHGKFR

SEQ ID NO: 851714 - protein, 128 aa, Homo sapiens; identical to SEQ ID NO: 851713

SEQ ID NO: 851715 - protein, 128 aa, Homo sapiens; identical to SEQ ID NO: 851713

SEQ ID NO: 851716 - protein, 128 aa, Homo sapiens; identical to SEQ ID NO: 851713

SEQ ID NO: 851717 - protein, 115 aa, Homo sapiens
MAAQINSLPSPSPGVPRLIGIRLTLPPPKVVDRWNEKRAMFGVYDNIGILGNFEKHPKELIRGPIWLRGWKGNELQRCIRKRKMVGSRMFADDLHNLNKRIRYLYKHFNRHGKFR

SEQ ID NO: 851718 - protein, 151 aa, Homo sapiens
DLTRGSDSGSQAEMKRKKHALHNTHQLARQFSSRRRIRPIPGRQRQRAASESGNARAKPQIPSSNLNGCRTANRDARRSGRPITAPPGGGPRLRLRPPLPPPARLRIPPWPQGPPLPSRRGGGRISAGQRRRVPGWAFSHPQERRQVHAGS

SEQ ID NO: 851719 - protein, 246 aa, Homo sapiens
DLTRGSDSGSQAEMKKEKTRVHNTHQLARQFSSRRRIRPIPGRQRQRAASESGNARAKPQIPSSNLNGCRTANRDARRSGRPITAPPGAGQGSGSGPRSHPRPACESLLGRKVPLCPVGGEEAVFLLARDVASLAGHSVTPRKGGVPRLIGIRLTLPPPKVVDRWNEKRAMFGVYDNIGILGNFEKHPKELIRGPIWLRGWKGNELQRCIRKRKMVGSRMFADDLHNLNKRIRYLYKHFNRHGKFR

SEQ ID NO: 851720 - protein, 128 aa, Homo sapiens; identical to SEQ ID NO: 851713

SEQ ID NO: 851721 - protein, 128 aa, Homo sapiens; identical to SEQ ID NO: 851713

SEQ ID NO: 851722 - protein, 149 aa, Homo sapiens
MSPFAQSAGRRPYFCWPETSRPWLGIQSPPGKEASPRWELEGIASNPGVPRLIGIRLTLPPPKVVDRWNEKRAMFGVYDNIGILGNFEKHPKELIRGPIWLRGWKGNELQRCIRKRKMVGSRMFADDLHNLNKRIRYLYKHFNRHGKFR

SEQ ID NO: 851723 - protein, 105 aa, Homo sapiens
QKPIERTTPRVSPHVNYGLWVSIACQHRLISCNQYATLVGDVGNRGGCTYVGAGIFGKSLYLCLKFSIKPKLLQKKSSKNKKFWFIKAIMFSPPISPLSHFLPLG

SEQ ID NO: 851724 - protein, 70 aa, Homo sapiens
NRLGTRLGVNRPRQQPQGLREMAGWHPPCGHCACPRCGWGLVAEFPFHFKLTGKSPAFLPFGPVLTYVAM

SEQ ID NO: 851725 - protein, 214 aa, Homo sapiens
WVGVEGVMWWSSTQNAGTEGEAGPPGLPGPPGPKGAPGKPGKPGEAGLPGLPGVDGLTGRDGPPGPKGAPGERGSLGPPGPPGLGGKGLPGPPGEAGVSGPPGGIGLRGPPGPSGLPGLPGPPGPPGPPGHPGVLPEGATDLQCPSICPPGPPGPPGMPGFKGPTGYKGEQGEVGKDGEKVTLAPPGPRLRAEWGCRAPGDYRGRPGHSGPWDR

SEQ ID NO: 851726 - protein, 701 aa, Homo sapiens
ALGLTEESGGRRRPRSRSGPGRRGRRVRPTGAPALLNEFSPFQRVGLPGPPGPPGPPGKPGQDGIDGEAGPPGLPGPPGPKGAPGKPGKPGEAGLPGLPGVDGLTGRDGPPGPKGAPGERGSLGPPGPPGLGGKGLPGPPGEAGVSGPPGGIGLRGPPGPSGLPGLPGPPGPPGPPGHPGVLPEGATDLQCPSICPPGPPGPPGMPGFKGPTGYKGEQGEVGKDGEKGDPGPPGPAGLPGSVGLQGPRGLRGLPGPLGPPGDRGPIGFRGPPGIPGAPGKAGDRGERGPEGFRGPKGDLGRPGPKGTPGVAGPSGEPGMPGKDGQNGVPGLDGQKGEAGRNGAPGEKGPNGLPGLPGRAGSKGEKGERGRAGELGEAGPSGEPGVPGDAGMPGERGEAGHRGSAGALGPQGPPGAPGVRGFQGQKGSMGDPGLPGPQGLRGDVGDRGPGGAAGPKGDQGIAGSDGLPGDKGELGPSGLVGPKGESGSRGELGPKGTQGPNGTSGVQGVPGPPGPLGLQGVPGVPGITGKPGVPGKEASEQRIRELCGGMISEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGTPGICDTSACQGAVLGGVGEKSGSRSS

SEQ ID NO: 851727 - protein, 580 aa, Homo sapiens
PPRLRPYARYGLGLLPWTPGEAGVSGPPGGIGLRGPPGPSGLPGLPGPPGPPGPPGHPGVLPEGATDLQCPSICPPGPPGPPGMPGFKGPTGYKGEQGEVGKDGEKGDPGPPGPAGLPGSVGLQGPRGLRGLPGPLGPPGDRGPIGFRGPPGIPGAPGKAGDRGERGPEGFRGPKGDLGRPGPKGTPGVAGPSGEPGMPGKDGQNGVPGLDGQKGEAGRNGAPGEKGPNGLPGLPGRAGSKGEKGERGRAGELGEAGPSGEPGVPGDAGMPGERGEAGHRGSAGALGPQGPPGAPGVRGFQGQKGSMGDPGLPGPQGLRGDVGDRGPGGAAGPKGDQGIAGSDGLPGDKGELGPSGLVGPKGESGSRGELGPKGTQGPNGTSGVQGVPGPPGPLGLQGVPGVPGITGKPGVPGKEASEQRIRELCGGMISEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGTPGICDTSACQGAVLGGVGEKSGSRSS

SEQ ID NO: 851728 - protein, 541 aa, Homo sapiens
KYYESSPGCNFITGPGYPVVSADWRYMTFQCPSICPPGPPGPPGMPGFKGPTGYKGEQGEVGKDGEKGDPGPPGPAGLPGSVGLQGPRGLRGLPGPLGPPGDRGPIGFRGPPGIPGAPGKAGDRGERGPEGFRGPKGDLGRPGPKGTPGVAGPSGEPGMPGKDGQNGVPGLDGQKGEAGRNGAPGEKGPNGLPGLPGRAGSKGEKGERGRAGELGEAGPSGEPGVPGDAGMPGERGEAGHRGSAGALGPQGPPGAPGVRGFQGQKGSMGDPGLPGPQGLRGDVGDRGPGGAAGPKGDQGIAGSDGLPGDKGELGPSGLVGPKGESGSRGELGPKGTQGPNGTSGVQGVPGPPGPLGLQGVPGVPGITGKPGVPGKEASEQRIRELCGGMISEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGTPGICDTSACQGAVLGGVGEKSGSRSS

SEQ ID NO: 851729 - protein, 751 aa, Homo sapiens
MAGPRACAPLLLLLLLGELLAAAGAQRVGLPGPPGPPGPPGKPGQDGIDGEAGPPGLPGPPGPKGAPGKPGKPGEAGLPGLPGVDGLTGRDGPPGPKGAPGERGSLGPPGPPGLGGKGLPGPPGEAGVSGPPGGIGLRGPPGPSGLPGLPGPPGPPGPPGHPGVLPEGATDLQCPSICPPGPPGPPGMPGFKGPTGYKGEQGEVGKDGEKAGGPGLGCPLRGWSDQMRRPQVHIRGVPAWPRGGAWTGLKGLVGTVTTDPARQGEATETRGTALELWGDPGPPGPAGLPGSVGLQGPRGLRGLPGPLGPPGDRGPIGFRGPPGIPGAPGKAGDRGERGPEGFRGPKGDLGRPGPKGTPGVAGPSGEPGMPGKDGQNGVPGLDGQKGEAGRNGAPGEKGPNGLPGLPGRAGSKGEKGERGRAGELGEAGPSGEPGVPGDAGMPGERGEAGHRGSAGALGPQGPPGAPGVRGFQGQKGSMGDPGLPGPQGLRGDVGDRGPGGAAGPKGDQGIAGSDGLPGDKGELGPSGLVGPKGESGSRGELGPKGTQGPNGTSGVQGVPGPPGPLGLQGVPGVPGITGKPGVPGKEASEQRIRELCGGMISEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGTPGICDTSACQGAVLGGVGEKSGSRSS

SEQ ID NO: 851730 - protein, 572 aa, Homo sapiens
MAGPRACAPLLLLLLLGELLAAAGAQRVGLPGPPGPPGPPGKPGQDGIDGEAGPPGLPGPPGPKGAPGKPGKPGEAGLPGLPGVDGLTGRDGPPGPKGAPGERGSLGPPGPPGLGGKGLPGPPGEAGVSGPPGGIGLRGPPGPSGLPGLPGPPGPPGPPGHPGVLPEGATDLQCPSICPPGPPGPPGMPGFKGPTGYKGEQGEVGKDGEKGDPGPPGPAGLPGSVGLQGPRGLRGLPGPLGPPGDRGPIGFRGPPGIPGAPGKAGDRGERGPEGFRGPKGDLGRPGPKGTPGVAGPSGEPGMPGKDGQNGVPGLDGQKGEAGRNGAPGEKGPNGLPGLPGRAGSKGEKGERGRAGELGEAGPSGEPGVPGDAGMPGERGEAGHRGSAGALGPQGPPGAPGVRGFQGQKGSMGDPGLPGPQGLRGDVGDRGPGGAAGPKGDQGIAGSDGLPGDKGELGPSGLVGPKGESGSRGELGPKGTQGPNGTSGVQGVPGPPGPLGLQGVPGVPGITGKPGVPGKEASEQRIRELCGGMISGKSATCTGCSGAHPRLGVPCLGLHRKPSCHCFPAKVSP

SEQ ID NO: 851731 - protein, 586 aa, Homo sapiens
MAGPRACAPLLLLLLLGELLAAAGAQRVGLPGPPGPPGPPGKPGQDGIDGEAGPPGLPGPPGPKGAPGKPGKPGEAGLPGLPGVDGLTGRDGPPGPKGAPGERGSLGPPGPPGLGGKGLPGPPGEAGVSGPPGGIGLRGPPGPSGLPGLPGPPGPPGPPGHPGVLPEGATDLQCPSICPPGPPGPPGMPGFKGPTGYKGEQGEVGKDGEKGDPGPPGPAGLPGSVGLQGPRGLRGLPGPLGPPGDRGPIGFRGPPGIPGAPGKAGDRGERGPEGFRGPKGDLGRPGPKGTPGVAGPSGEPGMPGKDGQNGVPGLDGQKGEAGRNGAPGEKGPNGLPGLPGRAGSKGEKGERGRAGELGEAGPSGEPGVPGDAGMPGERGEAGHRGSAGALGPQGPPGAPGVRGFQGQKGSMGDPGLPGPQGLRGDVGDRGPGGAAGPKGDQGIAGSDGLPGDKGELGPSGLVGPKGESGSRGELGPKGTQGPNGTSGVQGVPGPPGPLGLQGVPGVPGITGKPGVPGKEASEQRIRELCGGMISEQIAQLAAHLRKPLAPGSIGRPGPGTPGICDTSACQGAVLGGVGEKSGSRSS

SEQ ID NO: 851732 - protein, 572 aa, Homo sapiens; identical to SEQ ID NO: 851730

SEQ ID NO: 851733 - protein, 242 aa, Homo sapiens
LAGYRGLNWDKGELGPSGLVGPKGESGSRGELGPKGTQGPNGTSGVQGVPGPPGPLGLQGVPGVPGITGKPGVPGKEASEQRIRELCGGMISEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGTPGICDTSACQGAVLGGVGEKSGSRSS

SEQ ID NO: 851734 - protein, 153 aa, Homo sapiens
MISEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGTPGICDTSACQGAVLGGVGEKSGSRSS

SEQ ID NO: 851735 - protein, 213 aa, Homo sapiens
MARYWAKVPGPNGTSGVQGVPGPPGPLGLQGVPGVPGITGKPGVPGKEASEQRIRELCGGMISEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGTPGICDTSACQGAVLGGVGEKSGSRSS

SEQ ID NO: 851736 - protein, 206 aa, Homo sapiens
KKYGLRVRRPPVGLNSCTNGVDAHDVRPMLTNVWGEFQGKEASEQRIRELCGGMISEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGTPGICDTSACQGAVLGGVGEKSGSRSS

SEQ ID NO: 851737 - protein, 180 aa, Homo sapiens
NRLGTRLGVNRPRPWPGRARAPRSCSCSCSGSFWRPPGRREWDSPAPPAPQGRPGSPARTALTELCGGMISEQIAQLAAHLRKPLAPGSIGRPGPAGPPGPPGPPGLDGPEGDQGPQGPQGVPGTSKDGQDGAPGEPGPPGDPGLPGAIGAQGTPGICDTSACQGAVLGGVGEKSGSRSS

SEQ ID NO: 851738 - protein, 677 aa, Homo sapiens
MAGPRACAPLLLLLLLGELLAAAGAQRVGLPGPPGPPGPPGKPGQDGIDGEAGPPGLPGPPGPKGAPGKPGKPGEAGLPGLPGVDGLTGRDGPPGPKGAPGERGSLGPPGPPGLGGKGLPGPPGEAGVSGPPGGIGLRGPPGPSGLPGLPGPPGPPGPPGHPGVLPEGATDLQCPSICPPGPPGPPGMPGFKGPTGYKGEQGEVGKDGEKGDPGPPGPAGLPGSVGLQGPRGLRGLPGPLGPPGDRGPIGFRGPPGIPGAPGKAGDRGERGPEGFRGPKGDLGRPGPKGTPGVAGPSGEPGMPGKDGQNGVPGLDGQKGEAGRNGAPGEKGPNGLPGLPGRAGSKGEKGERGRAGELGEAGPSGEPGVPGDAGMPGERGEAGHRGSAGALGPQGPPGAPGVRGFQGQKGSMGDPGLPGPQGLRGDVGDRGPGGAAGPKGDQGIAGSDGLPGDKGELGPSGLVGPKGESGSRGELGPKGTQGPNGTSGVQGVPGPPGPLGLQGVPGVPGITGKPGVPGKEASEQRIRELCGGMISEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGEPTGGILAKTFKPLAQRGTA

SEQ ID NO: 851739 - protein, 264 aa, Homo sapiens
GLSRAWVLNKAEGKLEGREKGDPGPPGPAGLPGSVGLQGPRGLRGLPGPLGPPGDRGPIGFRGPPGIPGAPGKAGDRGERGPEGFRGPKGDLGRPGPKGTPGVAGPSGEPGMPGKDGQNGVPGLDGQKGEAGRNGAPGEKGPNGLPGLPGRAGSKGEKGERGRAGELGEAGPSGEPGVPGDAGMPGERGEAGHRGSAGALGPQGPPGAPGVRGFQAKKGSMGDPASRPSLEVRGTGREARPRNRLSRGLEKDWPGVAGGGEAAW

SEQ ID NO: 851740 - protein, 684 aa, Homo sapiens
MAGPRACAPLLLLLLLGELLAAAGAQRVGLPGPPGPPGPPGKPGQDGIDGEAGPPGLPGPPGPKGAPGKPGKPGEAGLPGLPGVDGLTGRDGPPGPKGAPGERGSLGPPGPPGLGGKGLPGPPGEAGVSGPPGGIGLRGPPGPSGLPGLPGPPGPPGPPGHPGVLPEGATDLQCPSICPPGPPGPPGMPGFKGPTGYKGEQGEVGKDGEKGDPGPPGPAGLPGSVGLQGPRGLRGLPGPLGPPGDRGPIGFRGPPGIPGAPGKAGDRGERGPEGFRGPKGDLGRPGPKGTPGVAGPSGEPGMPGKDGQNGVPGLDGQKGEAGRNGAPGEKGPNGLPGLPGRAGSKGEKGERGRAGELGEAGPSGEPGVPGDAGMPGERGEAGHRGSAGALGPQGPPGAPGVRGFQGQKGSMGDPGLPGPQGLRGDVGDRGPGGAAGPKGDQGIAGSDGLPGDKGELGPSGLVGPKGESGSRGELGPKGTQGPNGTSGVQGVPGPPGPLGLQGVPGVPGITGKPGVPGKEASEQRIRELCGGMISEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGTPGICDTSACQGAVLGGVGEKSGSRSS

SEQ ID NO: 851741 - protein, 684 aa, Homo sapiens; identical to SEQ ID NO: 851740

SEQ ID NO: 851742 - protein, 563 aa, Homo sapiens
NRLGTRLGVNRPRDRLRGPPGPSGLPGLPGPPGPPGPPGHPGVLPEGATDLQCPSICPPGPPGPPGMPGFKGPTGYKGEQGEVGKDGEKGDPGPPGPAGLPGSVGLQGPRGLRGLPGPLGPPGDRGPIGFRGPPGIPGAPGKAGDRGERGPEGFRGPKGDLGRPGPKGTPGVAGPSGEPGMPGKDGQNGVPGLDGQKGEAGRNGAPGEKGPNGLPGLPGRAGSKGEKGERGRAGELGEAGPSGEPGVPGDAGMPGERGEAGHRGSAGALGPQGPPGAPGVRGFQGQKGSMGDPGLPGPQGLRGDVGDRGPGGAAGPKGDQGIAGSDGLPGDKGELGPSGLVGPKGESGSRGELGPKGTQGPNGTSGVQGVPGPPGPLGLQGVPGVPGITGKPGVPGKEASEQRIRELCGGMISEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGTPGICDTSACQGAVLGGVGEKSGSRSS

SEQ ID NO: 851743 - protein, 684 aa, Homo sapiens; identical to SEQ ID NO: 851740

SEQ ID NO: 851744 - protein, 383 aa, Homo sapiens [sequence omitted]

SEQ ID NO: 851745 - protein, 732 aa, Homo sapiens
MAGPRACAPLLLLLLLGELLAAAGAQRVGLPGPPGPPGPPGKPGQDGIDGEAGPPGLPGPPGPKGAPGKPGKPGEAGLPGLPGVDGLTGRDGPPGPKGAPGERGSLGPPGPPGLGGKGLPGPPGEAGVSGPPGGIGLRGPPGPSGLPGLPGPPGPPGPPGHPGVLPEGATDLQCPSICPPGPPGPPGMPGFKGPTGYKGEQGEVGKDGEKGDPGPPGPAGLPGSVGLQGPRGLRGLPGPLGPPGDRGPIGFRGPPGIPGAPGKAGDRGERGPEGFRGPKGDLGRPGPKGTPGVAGPSGEPGMPGKDGQNGVPGLDGQKGEAGRNGAPGEKGPNGLPGLPGRAGSKGEKGERGRAGELGEAGPSGEPGVPGDAGMPGERGEAGHRGSAGALGPQGPPGAPGVRGFQGQKGSMGDPGLPGPQGLRGDVGDRGPGGAAGPKGDQGIAGSDGLPGDKGELGPSGLVGPKGESGSRGELGPKGTQGPNGTSGVQGVPGPPGPLGLQGVPGVPGITGKPGVPVRRFSGFSSFHRVEIVFFPEGSYFAGRRWECLTEAAAPMLTNVWGEFQGKEASEQRIRELCGGMISEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGTPGICDTSACQGAVLGGVGEKSGSRSS

SEQ ID NO: 851746 - protein, 365 aa, Homo sapiens
GTRVHRCLGEKGPNGLPGLPGRAGSKGEKGERGRAGELGEAGPSGEPGVPGDAGMPGERGEAGHRGSAGALGPQGPPGAPGVRGFQGQKGSMGDPGLPGPQGLRGDVGDRGPGGAAGPKGDQGIAGSDGLPGDKGELGPSGLVGPKGESGSRGELGPKGTQGPNGTSGVQGVPGPPGPLGLQGVPGVPGITGKPGVPGKEASEQRIRELCGGMISEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGTPGICDTSACQGAVLGGVGEKSGSRSS

SEQ ID NO: 851747 - protein, 153 aa, Homo sapiens; identical to SEQ ID NO: 851734

SEQ ID NO: 851748 - protein, 153 aa, Homo sapiens; identical to SEQ ID NO: 851734

SEQ ID NO: 851749 - protein, 248 aa, Homo sapiens
MQWVQEQRSVPLWLAGQVPKHPQGHFLHLPTQASQAPRGWGSFLAPAFITPKQLNHFPSIRRKTCFWKTAPCRYFMLYVTILLMILSRVNACTLVFPEEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGTPGICDTSACQGAVLGGVGEKSGSRSS

SEQ ID NO: 851750 - protein, 132 aa, Homo sapiens
ASGARTCKDGQDGAPSGKGPPPWASRRSWASRCHWGPGDTGDLRHLSLPRSRVRRGRGEIRLSKLIKFNVRKQVTRTPEAQWTVMKERRCRRRVTSRRGSAPGCPSAADWTRGPCQRAPSSGCRLTAYLKRP

SEQ ID NO: 851751 - protein, 441 aa, Homo sapiens
MAGPRACAPLLLLLLLGELLAAAGAQRVGLPGPPGPPGPPGKPGQDGIDGEAGPPGLPGPPGPKGAPGKPGKPGEAGLPGLPGVDGLTGRDGPPGPKGAPGERGSLGPPGPPGLGGKGLPGPPGEAGVSGPPGGIGLRGPPGPSGLPGLPGPPGPPGPPGHPGVLPEGATDLQCPSICPPGPPGPPGMPGFKGPTGYKGEQGEVGKDGEKGDPGPPGPAGLPGSVGLQGPRGLRGLPGPLGPPGDRGPIGFRGPPGIPGAPGKAGDRGERGPEGFRGPKGDLGRPGPKGTPGVAGPSGEPGMPGKDGQNGVPGLDGQKGEAGRNGAPGEKGPNGLPGLPGRAGSKGEKGERGQSWVSWVRPDPLENQERHTWRNADGTMPMGEKTDGMKDMGTHNRVDNQKGERSTKQGTPTKGAHTAEKTTHGLVTRKDTRGARKCDKTM

SEQ ID NO: 851752 - protein, 220 aa, Homo sapiens
MPLLPAPSPFPSPFSSPRPPYYPPEYTCSSETDAQSITYNGSMDSPVPLYPTDCPPSYEAVMGLRGDSQATLFDPQLHDGSCICERVASIVDVSMDSGSLVLSAIGDLPGGSSPSEDSCLLELQGSVRSVDYVLFRSIQRSRAGYCLSLDCGLRGLGEACEGPKGGRPFWLPLVTHVATVAFGRLGCPGGCPMAGLFSARPDGVKSSGIFRDRKTGEDLQ

SEQ ID NO: 851753 - protein, 668 aa, Homo sapiens; identical to SEQ ID NO: 739009

SEQ ID NO: 851754 - protein, 578 aa, Homo sapiens
MMPSPSDSSRSLTSRPSTRGLTHLRLHRPWLQALLTLGLVQVLLGILVVTFSMVASSVTTTESIKRSCPSWAGFSLAFSGVVGIVSWKRPFTLVISFFSLLSVLCVMLSMAGSVLSCKNAQLARDFQQCSLEGKVCVCCPSVPLLRPCPESGQELKVAPNSTCDEARGALKNLLFSVCGLTICAAIICTLSAIVCCIQIFSLDLVHTLAPERSVSGPLGPLGCTSPPPAPLLHTMLDLEEFVPPVPPPPYYPPEYTCSSETDAQSITYNGSMDSPVPLYPTDCPPSYEAVMGLRGDSQATLFDPQLHDGSCICERVASIVDVSMDSGSLVLSAIGDLPGGSSPSEDSCLLELQGSVRSVDYVLFRSIQRSRAGYCLSLDCGLRGPFEESPLPRRPPRAARSYSCSAPEAPPPLGAPTAARSCHRLEGWPPWVGPCFPELRRRVPRGGGRPAAAPPTRAPTRRFSDSSGSLTPPGHRPPHPASPPPLLLPRSHSDPGITTSSDTADFRDLYTKVLEEEAASVSSADTGLCSEACLFRLARCPSPKMRVALSDLQGHYGQGKGMAQVFKYRVTCAYAMGW

SEQ ID NO: 851755 - protein, 415 aa, Homo sapiens
PGGEFGTRDAQSITYNGSMDSPVPLYPTDCPPSYEAVMGLRGDSQATLFDPQLHDGSCICERVASIVDVSMDSGSLVLSAIGDLPGGSSPSEDSCLLELQGSVRSVDYVLFRSIQRSRAGYCLSLDCGLRGPFEESPLPRRPPRAARSYSCSAPEAPPPLGAPTAARSCHRLEGWPPWVGPCFPELRRRVPRGGGRPAAAPPTRAPTRRFSDSSGSLTPPGHRPPHPASPPPLLLPRSHSDPGITTSSDTADFRDLYTKVLEEEAASVSSADTGLCSEACLFRLARCPSPKLLRARSAEKRRPVPTFQKVPLPSGPAPAHSLGDLKGSWPGRGLVTRFLQISRKAPDPSGTGAHGHKQVPRSLWGRPGRESLHLRSCGDLSSSSSLRRLLSGRRLERGTRPHSLSLNGGSRETGL

SEQ ID NO: 851756 - protein, 176 aa, Homo sapiens
RPLPPTVSMDSGSLVLSAIGDLPGGSSPSEDSCLLELQGSVRSVDYVLFRSIQRSRAGYCLSLDCGLRGPFEESPLPRRPPRAARSYSCSAPEAPPPLGAPTAARSCHRLEGWPPWVGPCFPELRRRVPRGGGRPAAAPPTRAPTRRFSDSSGSLTPPGHRPPHPASPPPLLLPRS

SEQ ID NO: 851757 - protein, 668 aa, Homo sapiens; identical to SEQ ID NO: 739009

SEQ ID NO: 851758 - protein, 439 aa, Homo sapiens
MPLLPAPSPFPSPFSSPRPPYYPPEYTCSSETDAQSITYNGSMDSPVPLYPTDCPPSYEAVMGLRGDSQATLFDPQLHDGSCICERVASIVDVSMDSGSLVLSAIGDLPGGSSPSEDSCLLELQGSVRSVDYVLFRSIQRSRAGYCLSLDCGLRGPFEESPLPRRPPRAARSYSCSAPEAPPPLGAPTAARSCHRLEGWPPWVGPCFPELRRRVPRGGGRPAAAPPTRAPTRRFSDSSGSLTPPGHRPPHPASPPPLLLPRSHSDPGITTSSDTADFRDLYTKVLEEEAASVSSADTGLCSEACLFRLARCPSPKLLRARSAEKRRPVPTFQKVPLPSGPAPAHSLGDLKGSWPGRGLVTRFLQISRKAPDPSGTGAHGHKQVPRSLWGRPGRESLHLRSCGDLSSSSSLRRLLSGRRLERGTRPHSLSLNGGSRETGL

SEQ ID NO: 851759 - protein, 265 aa, Homo sapiens
RLQVEAGFNRAEATAARSCHRLEGWPPWVGPCFPELRRRVPRGGGRPAAAPPTRAPTRRFSDSSGSLTPPGHRPPHPASPPPLLLPRSHSDPGITTSSDTADFRDLYTKVLEEEAASVSSADTGLCSEACLFRLARCPSPKLLRARSAEKRRPVPTFQKVPLPSGPAPAHSLGDLKGSWPGRGLVTRFLQISRKAPDPSGTGAHGHKQVPRSLWGRPGRESLHLRSCGDLSSSSSLRRLLSGRRLERGTRPHSLSLNGGSRETGL

SEQ ID NO: 851760 - protein, 387 aa, Homo sapiens
MGEEGTGGTVHLLCLAASSGVPLFCRSSRGGAPARQQLPFSVIGSLNGVHMFGQNLEVQLSSARTENTTVVWKSFHDSITLIVLSSEVGISELRLERLLQMVFGAMVLLVGLEELTNIRNVERLKKDLRASYCLIDSFLGDSELIGDLTQCVDCVIPPEGSLLQEALSGFAEAAGTTFVSLVVSGRVVAATEGWWRLGTPEAVLLPWLVGSLPPQTARDYPVYLPHGSPTVPHRLLTLTLLPSLELCLLCGPSPPLSQLYPQLLERWWQPLLDPLRACLPLGPRALPSGFPLHTDILGLLLLHLELKRCLFTVEPLGDKEPSPEQRRRLLRNFYTLVTSTHFPPEPGPPEKTEDEVYQAQLPRACYLAVGDGHRHGAVSVSLFIRSQ

SEQ ID NO: 851761 - protein, 267 aa, Homo sapiens
MGEEGTGGTVHLLCLAASSGVPLFCRSSRGGAPARQQLPFSVIGSLNGVHMFGQNLEVQLSSARTENTTVVLLVGLEELTNIRNVERLKKDLRASYCLIDSFLGDSELIGDLTQCVDCVIPPEGSLLQSGGVRPGGGSNRGLVAAGDARGRAAPLAGGVPAAADRSRLPGVPAAREPHGPTPAPDPDSAAEPGAVSTLRAEPTPQPVVSTASGALVAATAGPVAGLSAVGTPGAAQWLPPSHRHPRGAVPPLNEGRPSPGPGVASKK

SEQ ID NO: 851762 - protein, 418 aa, Homo sapiens
MGEEGTGGTVHLLCLAASSGVPLFCRSSRGGAPARQQLPFSVIGSLNGVHMFGQNLEVQLSSARTENTTVVWKSFHDSITLIVLSSEVGISELRLERLLQMVFGAMVLLVGLEELTNIRNVERLKKDLRASYCLIDSFLGDSELIGDLTQCVDCVIPPEGSLLQEALSGFAEAAGTTFVSLVVSGRVVAATEGWWRLGTPEAVLLPWLVGSLPPQTARDYPVYLPHGSPTVPHRLLTLTLLPSLELCLLCGPSPPLSQLYPQLLERWWQPLLDPLRACLPLGPRALPSGFPLHTDILGLLLLHLELKRCLFTVEPLGDKEPSPEQRRRLLRNFYTLVTSTHFPPEPGPPEKTEDEVYQAQLPRACYLVLGTEEPGTGVRLVALQLGLRRLLLLLSPQSPTHGLRSLATHTLHALTPLL

SEQ ID NO: 851763 - protein, 318 aa, Homo sapiens
MVFGAMVLLVGLEELTNIRNVERLKKDLRASYCLIDSFLGDSELIGDLTQCVDCVIPPEGSLLQEALSGFAEAAGTTFVSLVVSGRVVAATEGWWRLGTPEAVLLPWLVGSLPPQTARDYPVYLPHGSPTVPHRLLTLTLLPSLELCLLCGPSPPLSQLYPQLLERWWQPLLDPLRACLPLGPRALPSGFPLHTDILGLLLLHLELKRCLFTVEPLGDKEPSPEQRRRLLRNFYTLVTSTHFPPEPGPPEKTEDEVYQAQLPRACYLVLGTEEPGTGVRLVALQLGLRRLLLLLSPQSPTHGLRSLATHTLHALTPLL

SEQ ID NO: 851764 - protein, 426 aa, Homo sapiens
MGEEGTGGTVHLLCLAASSGVPLFCRSSRGGAPARQQLPFSVIGSLNGVHMFGQNLEVQLSSARTENTTVVWKSFHDSITLIVLSSEVGISELRLERLLQMVFGAMVLLVGLEELTNIRNVERLKKDLRAGPFFLSKASYCLIDSFLGDSELIGDLTQCVDCVIPPEGSLLQEALSGFAEAAGTTFVSLVVSGRVVAATEGWWRLGTPEAVLLPWLVGSLPPQTARDYPVYLPHGSPTVPHRLLTLTLLPSLELCLLCGPSPPLSQLYPQLLERWWQPLLDPLRACLPLGPRALPSGFPLHTDILGLLLLHLELKRCLFTVEPLGDKEPSPEQRRRLLRNFYTLVTSTHFPPEPGPPEKTEDEVYQAQLPRACYLVLGTEEPGTGVRLVALQLGLRRLLLLLSPQSPTHGLRSLATHTLHALTPLL

SEQ ID NO: 851765 - protein, 361 aa, Homo sapiens
MGSLASQLPSLIPDVLYKKGSITLIVLSSEVGISELRLERLLQMVFGAMVLLVGLEELTNIRNVERLKKDLRASYCLIDSFLGDSELIGDLTQCVDCVIPPEGSLLQEALSGFAEAAGTTFVSLVVSGRVVAATEGWWRLGTPEAVLLPWLVGSLPPQTARDYPVYLPHGSPTVPHRLLTLTLLPSLELCLLCGPSPPLSQLYPQLLERWWQPLLDPLRACLPLGPRALPSGFPLHTDILGLLLLHLELKRCLFTVEPLGDKEPSPEQRRRLLRNFYTLVTSTHFPPEPGPPEKTEDEVYQAQLPRACYLVLGTEEPGTGVRLVALQLGLRRLLLLLSPQSPTHGLRSLATHTLHALTPLL

SEQ ID NO: 851766 - protein, 376 aa, Homo sapiens
MFGQNLEVQLSSARTENTTVVWKSFHDSITLIVLSSEVGISELRLERLLQMVFGAMVLLVGLEELTNIRNVERLKKDLRAGPFFLSKASYCLIDSFLGDSELIGDLTQCVDCVIPPEGSLLQEALSGFAEAAGTTFVSLVVSGRVVAATEGWWRLGTPEAVLLPWLVGSLPPQTARDYPVYLPHGSPTVPHRLLTLTLLPSLELCLLCGPSPPLSQLYPQLLERWWQPLLDPLRACLPLGPRALPSGFPLHTDILGLLLLHLELKRCLFTVEPLGDKEPSPEQRRRLLRNFYTLVTSTHFPPEPGPPEKTEDEVYQAQLPRACYLVLGTEEPGTGVRLVALQLGLRRLLLLLSPQSPTHGLRSLATHTLHALTPLL

SEQ ID NO: 851767 - protein, 266 aa, Homo sapiens
MFGQNLEVQLSSARTENTTVVWKSFHDSITLIVLSSEVGISELRLERLLQMVFGAMVLLVGLEELTNIRNVERLKKDLRASYCLIDSFLGDSELIGDLTQCVDCVIPPEGSLLQEALSGFAEAAGTTFVSLVVSGRVVAATEGWWRLGTPEAVLLPWLVGSLPPQTARDYPVYLPHGSPTVPHRLLTLTLLPSLELCLLCGPSPPLSQLYPQFWSAGEHVDRWGLLAWARRARFPYRIPGGSGGGFRLGKATAAQYGSHRRKFALG

SEQ ID NO: 851768 - protein, 382 aa, Homo sapiens
MGEEGTGGTVHLLCLAASSGVPLFCRSSRGGAPARQQLPFSVIGSLNGVHMFGQNLEVQLSSARTENTTVVLLVGLEELTNIRNVERLKKDLRASYCLIDSFLGDSELIGDLTQCVDCVIPPEGSLLQEALSGFAEAAGTTFVSLVVSGRVVAATEGWWRLGTPEAVLLPWLVGSLPPQTARDYPVYLPHGSPTVPHRLLTLTLLPSLELCLLCGPSPPLSQLYPQLLERWWQPLLDPLRACLPLGPRALPSGFPLHTDILGLLLLHLELKRCLFTVEPLGDKEPSPEQRRRLLRNFYTLVTSTHFPPEPGPPEKTEDEVYQAQLPRACYLVLGTEEPGTGVRLVALQLGLRRLLLLLSPQSPTHGLRSLATHTLHALTPLL

SEQ ID NO: 851769 - protein, 368 aa, Homo sapiens
MFGQNLEVQLSSARTENTTVVWKSFHDSITLIVLSSEVGISELRLERLLQMVFGAMVLLVGLEELTNIRNVERLKKDLRASYCLIDSFLGDSELIGDLTQCVDCVIPPEGSLLQEALSGFAEAAGTTFVSLVVSGRVVAATEGWWRLGTPEAVLLPWLVGSLPPQTARDYPVYLPHGSPTVPHRLLTLTLLPSLELCLLCGPSPPLSQLYPQLLERWWQPLLDPLRACLPLGPRALPSGFPLHTDILGLLLLHLELKRCLFTVEPLGDKEPSPEQRRRLLRNFYTLVTSTHFPPEPGPPEKTEDEVYQAQLPRACYLVLGTEEPGTGVRLVALQLGLRRLLLLLSPQSPTHGLRSLATHTLHALTPLL

SEQ ID NO: 851770 - protein, 361 aa, Homo sapiens; identical to SEQ ID NO: 851765

SEQ ID NO: 851771 - protein, 276 aa, Homo sapiens
RLGTRLGGCVDCVIPPEGSLLQEALSGFAEAAGTTFVSLVVSGRVVAATEGWWRLGTPEAVLLPWLVGSLPPQTARDYPVYLPHGSPTVPHRLLTLTLLPSLELCLLCGPSPPLSQLYPQLLERWWQPLLDPLRACLPLGPRALPSGFPLHTDILGLLLLHLELKRCLFTVEPLGDKEPSPEQRRRLLRNFYTLVTSTHFPPEPGPPEKTEDEVYQAQLPRACYLVLGTEEPGTGVRLVALQLGLRRLLLLLSPQSPTHGLRSLATHTLHALTPLL

SEQ ID NO: 851772 - protein, 260 aa, Homo sapiens
MASTRLVLIGTEAEAAGTTFVSLVVSGRVVAATEGWWRLGTPEAVLLPWLVGSLPPQTARDYPVYLPHGSPTVPHRLLTLTLLPSLELCLLCGPSPPLSQLYPQLLERWWQPLLDPLRACLPLGPRALPSGFPLHTDILGLLLLHLELKRCLFTVEPLGDKEPSPEQRRRLLRNFYTLVTSTHFPPEPGPPEKTEDEVYQAQLPRACYLVLGTEEPGTGVRLVALQLGLRRLLLLLSPQSPTHGLRSLATHTLHALTPLL

SEQ ID NO: 851773 - protein, 2052 aa, Homo sapiens
PRIRHEGLLHSAFFGDQTLQELKMASSVAPYEQLVRQVEALKAENSHLRQELRDNSSHLSKLETETSGMKEVLKHLQGKLEQEARVLVSSGQTEVLEQLKALQMDITSLYNLKFQPPTLGPEPAARTPEGSPVHGSGPSKDSFGELSRATIRLLEELDRERCFLLNEIEKEEKEKLWYYSQLQGLSKRLDELLQVDYEMHKMTRDPLNLALRRYAGMTLTNLTFGDVANKATLCARRGCMEAIVAQLASDSEELHQVVSSILRNLSWRADINSKKVLREAGSVTALVQCVLRATKESTLKSVLSALWNLSAHSTENKAAICQVDGALGFLVSTLTYKCQSNSLAIIESGGGILRNVSSLVATREDYRQVLRDHNCLQTLLQHLTSHSLTIVSNACGTLWNLSARSARDQELLWDLGAVGMLRNLVHSKHKMIAMGSAAALRNLLAHRPAKHQAAATAVSPGSCVPSLYVRKQRALEAELDARHLAQALEHLEKQGPPAAEAATKKPLPPLRHLDGLAQDYASDSGCFDDDDAPSSLAAAAATGEPASPAALSLFLGSPFLQGQALARTPPTRRGGKEAEKDTSGEAAVAAKAKAKLALAVARIDQLVEDISALHTSSDDSFSLSSGDPGQEAPREGRAQSCSPCRGPEGGRREAGSRAHPLLRLKAAHASLSNDSLNSGSASDGYCPREHMLPCPLAALASRREDPRCGQPRPSRLDLDLPGCQAEPPAREATSADARVRTIKLSPTYQHVPLLEGASRAGAEPLAGPGISPGARKQAWLPADHLSKVPEKLAAAPLSVASKALQKLAAQEGPLSLSRCSSLSSLSSAGRPGPSEGGDLDDSDSSLEGLEEAGPSEAELDSTWRAPGATSLPVAIPAPRRNRGRGLGVEDATPSSSSENYVQETPLVLSRCSSVSSLGSFESPSIASSIPSEPCSGQGSGTISPSELPDSPGQTMPPSRSKTPPLAPAPQGPPEATQFSLQWESYVKRFLDIADCRERCRLPSELDAGSVRFTVEKPDENFSCASSLSALALHEHYVQQDVELRLLPSACPERGGGAGGAGLHFAGHRRREEGPAPTGSRPRGAADQELELLRECLGAAVPARLRKVASALVPGRRALPVPVYMLVPAPAPAQEDDSCTDSAEGTPVNFSSAASLSDETLQGPPRDQPGGPAGRQRPTGRPTSARQAMGHRHKAGGAGRSAEQSRGAGKNRAGLELPLGRPPSAPADKDGSKPGRTRGDGALQSLCLTTPTEEAVYCFYGNDSDEEPPAAAPTPTHRRTSAIPRAFTRERPQGRKEAPAPSKAAPAAPPPARTQPSLIADETPPCYSLSSSASSLSEPEPSEPPAVHPRGREPAVTKDPGPGGGRDSSPSPRAAEELLQRCISSALPRRRPPVSGLRRRKPRATRLDERPAEGSRERGEEAAGSDRASDLDSVEWRAIQEGANSIVTWLHQAAAATREASSESDSILSFVSGLSVGSTLQPPKHRKGRQAEGEMGSARRPEKRGAASVKTSGSPRSPAGPEKPRGTQKTTPGVPAVLRGRTVIYVPSPAPRAQPKGTPGPRATPRKVAPPCLAQPAAPAKVPSPGQQRSRSLHRPAKTSELATLSQPPRSATPPARLAKTPSSSSSQTSPASQPLPRKRPPVTQAAGALPGPGASPVPKTPARTLLAKQHKTQRSPVRIPFMQRPARRGPPPLARAVPEPGPRGRAGTEAGPGARGGRLGLVRVASALSSGSESSDRSGFRRQLTFIKESPGLRRRRSELSSAESAASAPQGASPRRGRPALPAVFLCSSRCEELRAAPRQGPAPARQRPPAARPSPGERPARRTTSESPSRLPVRAPAARPETVKRYASLPHISVARRPDGAVPAAPASADAARRSSDGEPRPLPRVAAPGTTWRRIRDEDVPHILRSTLPATALPLRGSTPEDAPAGPPPRKTSDAVVQTEEVAAPKTNSSTSPSLETREPPGAPAGGQLSLLGSDVDGPSLAKAPISAPFVHEGLGVAVGGFPASRHGSPSRSARVPPFNYVPSPMVVAATTDSAAEKAPATASATLLE

SEQ ID NO: 851774 - protein, 2052 aa, Homo sapiens; identical to SEQ ID NO: 851773

SEQ ID NO: 851775 - protein, 1633 aa, Homo sapiens
MLRNLVHSKHKMIAMGSAAALRNLLAHRPAKHQAAATAVSPGSCVPSLYVRKQRALEAELDARHLAQALEHLEKQGPPAAEAATKKPLPPLRHLDGLAQDYASDSGCFDDDDAPSSLAAAAATGEPASPAALSLFLGSPFLQGQALARTPPTRRGGKEAEKDTSGEAAVAAKAKAKLALAVARIDQLVEDISALHTSSDDSFSLSSGDPGQEAPREGRAQSCSPCRGPEGGRREAGSRAHPLLRLKAAHASLSNDSLNSGSASDGYCPREHMLPCPLAALASRREDPRCGQPRPSRLDLDLPGCQAEPPAREATSADARVRTIKLSPTYQHVPLLEGASRAGAEPLAGPGISPGARKQAWLPADHLSKVPEKLAAAPLSVASKALQKLAAQEGPLSLSRCSSLSSLSSAGRPGPSEGGDLDDSDSSLEGLEEAGPSEAELDSTWRAPGATSLPVAIPAPRRNRGRGLGVEDATPSSSSENYVQETPLVLSRCSSVSSLGSFESPSIASSIPSEPCSGQGSGTISPSELPDSPGQTMPPSRSKTPPLAPAPQGPPEATQFSLQWESYVKRFLDIADCRERCRLPSELDAGSVRFTVEKPDENFSCASSLSALALHEHYVQQDVELRLLPSACPERGGGAGGAGLHFAGHRRREEGPAPTGSRPRGAADQELELLRECLGAAVPARLRKVASALVPGRRALPVPVYMLVPAPAPAQEDDSCTDSAEGTPVNFSSAASLSDETLQGPPRDQPGGPAGRQRPTGRPTSARQAMGHRHKAGGAGRSAEQSRGAGKNRAGLELPLGRPPSAPADKDGSKPGRTRGDGALQSLCLTTPTEEAVYCFYGNDSDEEPPAAAPTPTHRRTSAIPRAFTRERPQGRKEAPAPSKAAPAAPPPARTQPSLIADETPPCYSLSSSASSLSEPEPSEPPAVHPRGREPAVTKDPGPGGGRDSSPSPRAAEELLQRCISSALPRRRPPVSGLRRRKPRATRLDERPAEGSRERGEEAAGSDRASDLDSVEWRAIQEGANSIVTWLHQAAAATREASSESDSILSFVSGLSVGSTLQPPKHRKGRQAEGEMGSARRPEKRGAASVKTSGSPRSPAGPEKPRGTQKTTPGVPAVLRGRTVIYVPSPAPRAQPKGTPGPRATPRKVAPPCLAQPAAPAKVPSPGQQRSRSLHRPAKTSELATLSQPPRSATPPARLAKTPSSSSSQTSPASQPLPRKRPPVTQAAGALPGPGASPVPKTPARTLLAKQHKTQRSPVRIPFMQRPARRGPPPLARAVPEPGPRGRAGTEAGPGARGGRLGLVRVASALSSGSESSDRSGFRRQLTFIKESPGLRRRRSELSSAESAASAPQGASPRRGRPALPAVFLCSSRCEELRAAPRQGPAPARQRPPAARPSPGERPARRTTSESPSRLPVRAPAARPETVKRYASLPHISVARRPDGAVPAAPASADAARRSSDGEPRPLPRVAAPGTTWRRIRDEDVPHILRSTLPATALPLRGSTPEDAPAGPPPRKTSDAVVQTEEVAAPKTNSSTSPSLETREPPGAPAGGQLSLLGSDVDGPSLAKAPISAPFVHEGLGVAVGGFPASRHGSPSRSARVPPFNYVPSPMVVAATTDSAAEKAPATASATLLE

SEQ ID NO: 851776 - protein, 2385 aa, Homo sapiens
MGKEQRGKGGVKGVPAGGPSRGRRRRPAGQREEARPEPEDGQRHKEASALAESRDGAEAAGASRDQLKAAQGVRATQTLQELKMASSVAPYEQLVRQVEALKAENSHLRQELRDNSSHLSKLETETSGMKEVLKHLQGKLEQEARVLVSSGQTEVLEQLKALQMDITSLYNLKFQPPTLGPEPAARTPEGSPVHGSGPSKDSFGELSRATIRLLEELDRERCFLLNEIEKEEKEKLWYYSQLQGLSKRLDELPHVETFSMQMDLIRQQLEFEAQHIRSLMEERFGTSDEMVQRAQIRASRLEQIDKELLEAQDRVQQTEPQALLAVKSVPVDEDPETEVPTHPEDGTPQPGNSKVEVVFWLLSMLATRDQEDTARTLLAMSSSPESCVAMRRSGCLPLLLQILHGTEAAAGGRAGAPGAPGAKDARMRANAALHNIVFSQPDQGLARKEMRVLHVLEQIRAYCETCWDWLQARDGGPEGGGAGSAPIPIEPQICQATCAVMKLSFDEEYRRAMNELGGLQAVAELLQVDYEMHKMTRDPLNLALRRYAGMTLTNLTFGDVANKATLCARRGCMEAIVAQLASDSEELHQVVSSILRNLSWRADINSKKVLREAGSVTALVQCVLRATKESTLKSVLSALWNLSAHSTENKAAICQVDGALGFLVSTLTYKCQSNSLAIIESGGGILRNVSSLVATREDYRQVLRDHNCLQTLLQHLTSHSLTIVSNACGTLWNLSARSARDQELLWDLGAVGMLRNLVHSKHKMIAMGSAAALRNLLAHRPAKHQAAATAVSPGSCVPSLYVRKQRALEAELDARHLAQALEHLEKQGPPAAEAATKKPLPPLRHLDGLAQDYASDSGCFDDDDAPSSLAAAAATGEPASPAALSLFLGSPFLQGQALARTPPTRRGGKEAEKDTSGEAAVAAKAKAKLALAVARIDQLVEDISALHTSSDDSFSLSSGDPGQEAPREGRAQSCSPCRGPEGGRREAGSRAHPLLRLKAAHASLSNDSLNSGSASDGYCPREHMLPCPLAALASRREDPRCGQPRPSRLDLDLPGCQAEPPAREATSADARVRTIKLSPTYQHVPLLEGASRAGAEPLAGPGISPGARKQAWLPADHLSKVPEKLAAAPLSVASKALQKLAAQEGPLSLSRCSSLSSLSSAGRPGPSEGGDLDDSDSSLEGLEEAGPSEAELDSTWRAPGATSLPVAIPAPRRNRGRGLGVEDATPSSSSENYVQETPLVLSRCSSVSSLGSFESPSIASSIPSEPCSGQGSGTISPSELPDSPGQTMPPSRSKTPPLAPAPQGPPEATQFSLQWESYVKRFLDIADCRERCRLPSELDAGSVRFTVEKPDENFSCASSLSALALHEHYVQQDVELRLLPSACPERGGGAGGAGLHFAGHRRREEGPAPTGSRPRGAADQELELLRECLGAAVPARLRKVASALVPGRRALPVPVYMLVPAPAPAQEDDSCTDSAEGTPVNFSSAASLSDETLQGPPRDQPGGPAGRQRPTGRPTSARQAMGHRHKAGGAGRSAEQSRGAGKNRAGLELPLGRPPSAPADKDGSKPGRTRGDGALQSLCLTTPTEEAVYCFYGNDSDEEPPAAAPTPTHRRTSAIPRAFTRERPQGRKEAPAPSKAAPAAPPPARTQPSLIADETPPCYSLSSSASSLSEPEPSEPPAVHPRGREPAVTKDPGPGGGRDSSPSPRAAEELLQRCISSALPRRRPPVSGLRRRKPRATRLDERPAEGSRERGEEAAGSDRASDLDSVEWRAIQEGANSIVTWLHQAAAATREASSESDSILSFVSGLSVGSTLQPPKHRKGRQAEGEMGSARRPEKRGAASVKTSGSPRSPAGPEKPRGTQKTTPGVPAVLRGRTVIYVPSPAPRAQPKGTPGPRATPRKVAPPCLAQPAAPAKVPSPGQQRSRSLHRPAKTSELATLSQPPRSATPPARLAKTPSSSSSQTSPASQPLPRKRPPVTQAAGALPGPGASPVPKTPARTLLAKQHKTQRSPVRIPFMQRPARRGPPPLARAVPEPGPRGRAGTEAGPGARGGRLGLVRVASALSSGSESSDRSGFRRQLTFIKESPGLRRRRSELSSAESAASAPQGASPRRGRPALPAVFLCSSRCEELRAAPRQGPAPARQRPPAARPSPGERPARRTTSESPSRLPVRAPAARPETVKRYASLPHISVARRPDGAVPAAPASADAARRSSDGEPRPLPRVAAPGTTWRRIRDEDVPHILRSTLPATALPLRGSTPEDAPAGPPPRKTSDAVVQTEEVAAPKTNSSTSPSLETREPPGAPAGGQLSLLGSDVDGPSLAKAPISAPFVHEGLGVAVGGFPASRHGSPSRSARVPPFNYVPSPMVVAATTDSAAEKAPATASATLLE

SEQ ID NO: 851777 - protein, 2322 aa, Homo sapiens
GFLSLLHSAFFGDQTLQELKMASSVAPYEQLVRQVEALKAENSHLRQELRDNSSHLSKLETETSGMKEVLKHLQGKLEQEARVLVSSGQTEVLEQLKALQMDITSLYNLKFQPPTLGPEPAARTPEGSPVHGSGPSKDSFGELSRATIRLLEELDRERCFLLNEIEKEEKEKLWYYSQLQGLSKRLDELPHVETFSMQMDLIRQQLEFEAQHIRSLMEERFGTSDEMVQRAQIRASRLEQIDKELLEAQDRVQQTEPQALLAVKSVPVDEDPETEVPTHPEDGTPQPGNSKVEVVFWLLSMLATRDQEDTARTLLAMSSSPESCVAMRRSGCLPLLLQILHGTEAAAGGRAGAPGAPGAKDARMRANAALHNIVFSQPDQGLARKEMRVLHVLEQIRAYCETCWDWLQARDGGPEGGGAGSAPIPIEPQICQATCAVMKLSFDEEYRRAMNELGGLQAVAELLQVDYEMHKMTRDPLNLALRRYAGMTLTNLTFGDVANKATLCARRGCMEAIVAQLASDSEELHQVVSSILRNLSWRADINSKKVLREAGSVTALVQCVLRATKESTLKSVLSALWNLSAHSTENKAAICQVDGALGFLVSTLTYKCQSNSLAIIESGGGILRNVSSLVATREDYRQVLRDHNCLQTLLQHLTSHSLTIVSNACGTLWNLSARSARDQELLWDLGAVGMLRNLVHSKHKMIAMGSAAALRNLLAHRPAKHQAAATAVSPGSCVPSLYVRKQRALEAELDARHLAQALEHLEKQGPPAAEAATKKPLPPLRHLDGLAQDYASDSGCFDDDDAPSSLAAAAATGEPASPAALSLFLGSPFLQGQALARTPPTRRGGKEAEKDTSGEAAVAAKAKAKLALAVARIDQLVEDISALHTSSDDSFSLSSGDPGQEAPREGRAQSCSPCRGPEGGRREAGSRAHPLLRLKAAHASLSNDSLNSGSASDGYCPREHMLPCPLAALASRREDPRCGQPRPSRLDLDLPGCQAEPPAREATSADARVRTIKLSPTYQHVPLLEGASRAGAEPLAGPGISPGARKQAWLPADHLSKVPEKLAAAPLSVASKALQKLAAQEGPLSLSRCSSLSSLSSAGRPGPSEGGDLDDSDSSLEGLEEAGPSEAELDSTWRAPGATSLPVAIPAPRRNRGRGLGVEDATPSSSSENYVQETPLVLSRCSSVSSLGSFESPSIASSIPSEPCSGQGSGTISPSELPDSPGQTMPPSRSKTPPLAPAPQGPPEATQFSLQWESYVKRFLDIADCRERCRLPSELDAGSVRFTVEKPDENFSCASSLSALALHEHYVQQDVELRLLPSACPERGGGAGGAGLHFAGHRRREEGPAPTGSRPRGAADQELELLRECLGAAVPARLRKVASALVPGRRALPVPVYMLVPAPAPAQEDDSCTDSAEGTPVNFSSAASLSDETLQGPPRDQPGGPAGRQRPTGRPTSARQAMGHRHKAGGAGRSAEQSRGAGKNRAGLELPLGRPPSAPADKDGSKPGRTRGDGALQSLCLTTPTEEAVYCFYGNDSDEEPPAAAPTPTHRRTSAIPRAFTRERPQGRKEAPAPSKAAPAAPPPARTQPSLIADETPPCYSLSSSASSLSEPEPSEPPAVHPRGREPAVTKDPGPGGGRDSSPSPRAAEELLQRCISSALPRRRPPVSGLRRRKPRATRLDERPAEGSRERGEEAAGSDRASDLDSVEWRAIQEGANSIVTWLHQAAAATREASSESDSILSFVSGLSVGSTLQPPKHRKGRQAEGEMGSARRPEKRGAASVKTSGSPRSPAGPEKPRGTQKTTPGVPAVLRGRTVIYVPSPAPRAQPKGTPGPRATPRKVAPPCLAQPAAPAKVPSPGQQRSRSLHRPAKTSELATLSQPPRSATPPARLAKTPSSSSSQTSPASQPLPRKRPPVTQAAGALPGPGASPVPKTPARTLLAKQHKTQRSPVRIPFMQRPARRGPPPLARAVPEPGPRGRAGTEAGPGARGGRLGLVRVASALSSGSESSDRSGFRRQLTFIKESPGLRRRRSELSSAESAASAPQGASPRRGRPALPAVFLCSSRCEELRAAPRQGPAPARQRPPAARPSPGERPARRTTSESPSRLPVRAPAARPETVKRYASLPHISVARRPDGAVPAAPASADAARRSSDGEPRPLPRVAAPGTTWRRIRDEDVPHILRSTLPATALPLRGSTPEDAPAGPPPRKTSDAVVQTEEVAAPKTNSSTSPSLETREPPGAPAGGQLSLLGSDVDGPSLAKAPISAPFVHEGLGVAVGGFPASRHGSPSRSARVPPFNYVPSPMVVAATTDSAAEKAPATASATLLE

SEQ ID NO: 851778 - protein, 154 aa, Homo sapiens
AADGAPGTGWGRARDQGWCRPRQNGAPRVLPAPAHIITGEQTGCSGTVPPTLVLSLQALLAVKSVPVDEDPETEVPTHPEDGTPQPGNSKVRGRVKRGLAQLSGLEGGSGLHPRQWWCPPMPPSSTPSGVGRPLWRAAHAEAAGLARWMGKYVP

SEQ ID NO: 851779 - protein, 2302 aa, Homo sapiens
MASSVAPYEQLVRQVEALKAENSHLRQELRDNSSHLSKLETETSGMKEVLKHLQGKLEQEARVLVSSGQTEVLEQLKALQMDITSLYNLKFQPPTLGPEPAARTPEGSPVHGSGPSKDSFGELSRATIRLLEELDRERCFLLNEIEKEEKEKLWYYSQLQGLSKRLDELPHVETFSMQMDLIRQQLEFEAQHIRSLMEERFGTSDEMVQRAQIRASRLEQIDKELLEAQDRVQQTEPQALLAVKSVPVDEDPETEVPTHPEDGTPQPGNSKVEVVFWLLSMLATRDQEDTARTLLAMSSSPESCVAMRRSGCLPLLLQILHGTEAAAGGRAGAPGAPGAKDARMRANAALHNIVFSQPDQGLARKEMRVLHVLEQIRAYCETCWDWLQARDGGPEGGGAGSAPIPIEPQICQATCAVMKLSFDEEYRRAMNELGGLQAVAELLQVDYEMHKMTRDPLNLALRRYAGMTLTNLTFGDVANKATLCARRGCMEAIVAQLASDSEELHQVVSSILRNLSWRADINSKKVLREAGSVTALVQCVLRATKESTLKSVLSALWNLSAHSTENKAAICQVDGALGFLVSTLTYKCQSNSLAIIESGGGILRNVSSLVATREDYRQVLRDHNCLQTLLQHLTSHSLTIVSNACGTLWNLSARSARDQELLWDLGAVGMLRNLVHSKHKMIAMGSAAALRNLLAHRPAKHQAAATAVSPGSCVPSLYVRKQRALEAELDARHLAQALEHLEKQGPPAAEAATKKPLPPLRHLDGLAQDYASDSGCFDDDDAPSSLAAAAATGEPASPAALSLFLGSPFLQGQALARTPPTRRGGKEAEKDTSGEAAVAAKAKAKLALAVARIDQLVEDISALHTSSDDSFSLSSGDPGQEAPREGRAQSCSPCRGPEGGRREAGSRAHPLLRLKAAHASLSNDSLNSGSASDGYCPREHMLPCPLAALASRREDPRCGQPRPSRLDLDLPGCQAEPPAREATSADARVRTIKLSPTYQHVPLLEGASRAGAEPLAGPGISPGARKQAWLPADHLSKVPEKLAAAPLSVASKALQKLAAQEGPLSLSRCSSLSSLSSAGRPGPSEGGDLDDSDSSLEGLEEAGPSEAELDSTWRAPGATSLPVAIPAPRRNRGRGLGVEDATPSSSSENYVQETPLVLSRCSSVSSLGSFESPSIASSIPSEPCSGQGSGTISPSELPDSPGQTMPPSRSKTPPLAPAPQGPPEATQFSLQWESYVKRFLDIADCRERCRLPSELDAGSVRFTVEKPDENFSCASSLSALALHEHYVQQDVELRLLPSACPERGGGAGGAGLHFAGHRRREEGPAPTGSRPRGAADQELELLRECLGAAVPARLRKVASALVPGRRALPVPVYMLVPAPAPAQEDDSCTDSAEGTPVNFSSAASLSDETLQGPPRDQPGGPAGRQRPTGRPTSARQAMGHRHKAGGAGRSAEQSRGAGKNRAGLELPLGRPPSAPADKDGSKPGRTRGDGALQSLCLTTPTEEAVYCFYGNDSDEEPPAAAPTPTHRRTSAIPRAFTRERPQGRKEAPAPSKAAPAAPPPARTQPSLIADETPPCYSLSSSASSLSEPEPSEPPAVHPRGREPAVTKDPGPGGGRDSSPSPRAAEELLQRCISSALPRRRPPVSGLRRRKPRATRLDERPAEGSRERGEEAAGSDRASDLDSVEWRAIQEGANSIVTWLHQAAAATREASSESDSILSFVSGLSVGSTLQPPKHRKGRQAEGEMGSARRPEKRGAASVKTSGSPRSPAGPEKPRGTQKTTPGVPAVLRGRTVIYVPSPAPRAQPKGTPGPRATPRKVAPPCLAQPAAPAKVPSPGQQRSRSLHRPAKTSELATLSQPPRSATPPARLAKTPSSSSSQTSPASQPLPRKRPPVTQAAGALPGPGASPVPKTPARTLLAKQHKTQRSPVRIPFMQRPARRGPPPLARAVPEPGPRGRAGTEAGPGARGGRLGLVRVASALSSGSESSDRSGFRRQLTFIKESPGLRRRRSELSSAESAASAPQGASPRRGRPALPAVFLCSSRCEELRAAPRQGPAPARQRPPAARPSPGERPARRTTSESPSRLPVRAPAARPETVKRYASLPHISVARRPDGAVPAAPASADAARRSSDGEPRPLPRVAAPGTTWRRIRDEDVPHILRSTLPATALPLRGSTPEDAPAGPPPRKTSDAVVQTEEVAAPKTNSSTSPSLETREPPGAPAGGQLSLLGSDVDGPSLAKAPISAPFVHEGLGVAVGGFPASRHGSPSRSARVPPFNYVPSPMVVAATTDSAAEKAPATASATLLE

SEQ ID NO: 851780 - protein, 2371 aa, Homo sapiens
QRRLPRPGPGFVRPGAPARAAETPEPARSEATPGRDFRWGPRSRAEGGGPRPRRPASPAARKRTLQELKMASSVAPYEQLVRQVEALKAENSHLRQELRDNSSHLSKLETETSGMKEVLKHLQGKLEQEARVLVSSGQTEVLEQLKALQMDITSLYNLKFQPPTLGPEPAARTPEGSPVHGSGPSKDSFGELSRATIRLLEELDRERCFLLNEIEKEEKEKLWYYSQLQGLSKRLDELPHVETFSMQMDLIRQQLEFEAQHIRSLMEERFGTSDEMVQRAQIRASRLEQIDKELLEAQDRVQQTEPQALLAVKSVPVDEDPETEVPTHPEDGTPQPGNSKVEVVFWLLSMLATRDQEDTARTLLAMSSSPESCVAMRRSGCLPLLLQILHGTEAAAGGRAGAPGAPGAKDARMRANAALHNIVFSQPDQGLARKEMRVLHVLEQIRAYCETCWDWLQARDGGPEGGGAGSAPIPIEPQICQATCAVMKLSFDEEYRRAMNELGGLQAVAELLQVDYEMHKMTRDPLNLALRRYAGMTLTNLTFGDVANKATLCARRGCMEAIVAQLASDSEELHQVVSSILRNLSWRADINSKKVLREAGSVTALVQCVLRATKESTLKSVLSALWNLSAHSTENKAAICQVDGALGFLVSTLTYKCQSNSLAIIESGGGILRNVSSLVATREDYRQVLRDHNCLQTLLQHLTSHSLTIVSNACGTLWNLSARSARDQELLWDLGAVGMLRNLVHSKHKMIAMGSAAALRNLLAHRPAKHQAAATAVSPGSCVPSLYVRKQRALEAELDARHLAQALEHLEKQGPPAAEAATKKPLPPLRHLDGLAQDYASDSGCFDDDDAPSSLAAAAATGEPASPAALSLFLGSPFLQGQALARTPPTRRGGKEAEKDTSGEAAVAAKAKAKLALAVARIDQLVEDISALHTSSDDSFSLSSGDPGQEAPREGRAQSCSPCRGPEGGRREAGSRAHPLLRLKAAHASLSNDSLNSGSASDGYCPREHMLPCPLAALASRREDPRCGQPRPSRLDLDLPGCQAEPPAREATSADARVRTIKLSPTYQHVPLLEGASRAGAEPLAGPGISPGARKQAWLPADHLSKVPEKLAAAPLSVASKALQKLAAQEGPLSLSRCSSLSSLSSAGRPGPSEGGDLDDSDSSLEGLEEAGPSEAELDSTWRAPGATSLPVAIPAPRRNRGRGLGVEDATPSSSSENYVQETPLVLSRCSSVSSLGSFESPSIASSIPSEPCSGQGSGTISPSELPDSPGQTMPPSRSKTPPLAPAPQGPPEATQFSLQWESYVKRFLDIADCRERCRLPSELDAGSVRFTVEKPDENFSCASSLSALALHEHYVQQDVELRLLPSACPERGGGAGGAGLHFAGHRRREEGPAPTGSRPRGAADQELELLRECLGAAVPARLRKVASALVPGRRALPVPVYMLVPAPAPAQEDDSCTDSAEGTPVNFSSAASLSDETLQGPPRDQPGGPAGRQRPTGRPTSARQAMGHRHKAGGAGRSAEQSRGAGKNRAGLELPLGRPPSAPADKDGSKPGRTRGDGALQSLCLTTPTEEAVYCFYGNDSDEEPPAAAPTPTHRRTSAIPRAFTRERPQGRKEAPAPSKAAPAAPPPARTQPSLIADETPPCYSLSSSASSLSEPEPSEPPAVHPRGREPAVTKDPGPGGGRDSSPSPRAAEELLQRCISSALPRRRPPVSGLRRRKPRATRLDERPAEGSRERGEEAAGSDRASDLDSVEWRAIQEGANSIVTWLHQAAAATREASSESDSILSFVSGLSVGSTLQPPKHRKGRQAEGEMGSARRPEKRGAASVKTSGSPRSPAGPEKPRGTQKTTPGVPAVLRGRTVIYVPSPAPRAQPKGTPGPRATPRKVAPPCLAQPAAPAKVPSPGQQRSRSLHRPAKTSELATLSQPPRSATPPARLAKTPSSSSSQTSPASQPLPRKRPPVTQAAGALPGPGASPVPKTPARTLLAKQHKTQRSPVRIPFMQRPARRGPPPLARAVPEPGPRGRAGTEAGPGARGGRLGLVRVASALSSGSESSDRSGFRRQLTFIKESPGLRRRRSELSSAESAASAPQGASPRRGRPALPAVFLCSSRCEELRAAPRQGPAPARQRPPAARPSPGERPARRTTSESPSRLPVRAPAARPETVKRYASLPHISVARRPDGAVPAAPASADAARRSSDGEPRPLPRVAAPGTTWRRIRDEDVPHILRSTLPATALPLRGSTPEDAPAGPPPRKTSDAVVQTEEVAAPKTNSSTSPSLETREPPGAPAGGQLSLLGSDVDGPSLAKAPISAPFVHEGLGVAVGGFPASRHGSPSRSARVPPFNYVPSPMVVAATTDSAAEKAPATASATLLE

SEQ ID NO: 851781 - protein, 1885 aa, Homo sapiens
MKLSFDEEYRRAMNELGGLQAVAELLQVDYEMHKMTRDPLNLALRRYAGMTLTNLTFGDVANKATLCARRGCMEAIVAQLASDSEELHQVVSSILRNLSWRADINSKKVLREAGSVTALVQCVLRATKESTLKSVLSALWNLSAHSTENKAAICQVDGALGFLVSTLTYKCQSNSLAIIESGGGILRNVSSLVATREDYRQVLRDHNCLQTLLQHLTSHSLTIVSNACGTLWNLSARSARDQELLWDLGAVGMLRNLVHSKHKMIAMGSAAALRNLLAHRPAKHQAAATAVSPGSCVPSLYVRKQRALEAELDARHLAQALEHLEKQGPPAAEAATKKPLPPLRHLDGLAQDYASDSGCFDDDDAPSSLAAAAATGEPASPAALSLFLGSPFLQGQALARTPPTRRGGKEAEKDTSGEAAVAAKAKAKLALAVARIDQLVEDISALHTSSDDSFSLSSGDPGQEAPREGRAQSCSPCRGPEGGRREAGSRAHPLLRLKAAHASLSNDSLNSGSASDGYCPREHMLPCPLAALASRREDPRCGQPRPSRLDLDLPGCQAEPPAREATSADARVRTIKLSPTYQHVPLLEGASRAGAEPLAGPGISPGARKQAWLPADHLSKVPEKLAAAPLSVASKALQKLAAQEGPLSLSRCSSLSSLSSAGRPGPSEGGDLDDSDSSLEGLEEAGPSEAELDSTWRAPGATSLPVAIPAPRRNRGRGLGVEDATPSSSSENYVQETPLVLSRCSSVSSLGSFESPSIASSIPSEPCSGQGSGTISPSELPDSPGQTMPPSRSKTPPLAPAPQGPPEATQFSLQWESYVKRFLDIADCRERCRLPSELDAGSVRFTVEKPDENFSCASSLSALALHEHYVQQDVELRLLPSACPERGGGAGGAGLHFAGHRRREEGPAPTGSRPRGAADQELELLRECLGAAVPARLRKVASALVPGRRALPVPVYMLVPAPAPAQEDDSCTDSAEGTPVNFSSAASLSDETLQGPPRDQPGGPAGRQRPTGRPTSARQAMGHRHKAGGAGRSAEQSRGAGKNRAGLELPLGRPPSAPADKDGSKPGRTRGDGALQSLCLTTPTEEAVYCFYGNDSDEEPPAAAPTPTHRRTSAIPRAFTRERPQGRKEAPAPSKAAPAAPPPARTQPSLIADETPPCYSLSSSASSLSEPEPSEPPAVHPRGREPAVTKDPGPGGGRDSSPSPRAAEELLQRCISSALPRRRPPVSGLRRRKPRATRLDERPAEGSRERGEEAAGSDRASDLDSVEWRAIQEGANSIVTWLHQAAAATREASSESDSILSFVSGLSVGSTLQPPKHRKGRQAEGEMGSARRPEKRGAASVKTSGSPRSPAGPEKPRGTQKTTPGVPAVLRGRTVIYVPSPAPRAQPKGTPGPRATPRKVAPPCLAQPAAPAKVPSPGQQRSRSLHRPAKTSELATLSQPPRSATPPARLAKTPSSSSSQTSPASQPLPRKRPPVTQAAGALPGPGASPVPKTPARTLLAKQHKTQRSPVRIPFMQRPARRGPPPLARAVPEPGPRGRAGTEAGPGARGGRLGLVRVASALSSGSESSDRSGFRRQLTFIKESPGLRRRRSELSSAESAASAPQGASPRRGRPALPAVFLCSSRCEELRAAPRQGPAPARQRPPAARPSPGERPARRTTSESPSRLPVRAPAARPETVKRYASLPHISVARRPDGAVPAAPASADAARRSSDGEPRPLPRVAAPGTTWRRIRDEDVPHILRSTLPATALPLRGSTPEDAPAGPPPRKTSDAVVQTEEVAAPKTNSSTSPSLETREPPGAPAGGQLSLLGSDVDGPSLAKAPISAPFVHEGLGVAVGGFPASRHGSPSRSARVPPFNYVPSPMVVAATTDSAAEKAPATASATLLE

SEQ ID NO: 851782 - protein, 1854 aa, Homo sapiens
MHKMTRDPLNLALRRYAGMTLTNLTFGDVANKATLCARRGCMEAIVAQLASDSEELHQVVSSILRNLSWRADINSKKVLREAGSVTALVQCVLRATKESTLKSVLSALWNLSAHSTENKAAICQVDGALGFLVSTLTYKCQSNSLAIIESGGGILRNVSSLVATREDYRQVLRDHNCLQTLLQHLTSHSLTIVSNACGTLWNLSARSARDQELLWDLGAVGMLRNLVHSKHKMIAMGSAAALRNLLAHRPAKHQAAATAVSPGSCVPSLYVRKQRALEAELDARHLAQALEHLEKQGPPAAEAATKKPLPPLRHLDGLAQDYASDSGCFDDDDAPSSLAAAAATGEPASPAALSLFLGSPFLQGQALARTPPTRRGGKEAEKDTSGEAAVAAKAKAKLALAVARIDQLVEDISALHTSSDDSFSLSSGDPGQEAPREGRAQSCSPCRGPEGGRREAGSRAHPLLRLKAAHASLSNDSLNSGSASDGYCPREHMLPCPLAALASRREDPRCGQPRPSRLDLDLPGCQAEPPAREATSADARVRTIKLSPTYQHVPLLEGASRAGAEPLAGPGISPGARKQAWLPADHLSKVPEKLAAAPLSVASKALQKLAAQEGPLSLSRCSSLSSLSSAGRPGPSEGGDLDDSDSSLEGLEEAGPSEAELDSTWRAPGATSLPVAIPAPRRNRGRGLGVEDATPSSSSENYVQETPLVLSRCSSVSSLGSFESPSIASSIPSEPCSGQGSGTISPSELPDSPGQTMPPSRSKTPPLAPAPQGPPEATQFSLQWESYVKRFLDIADCRERCRLPSELDAGSVRFTVEKPDENFSCASSLSALALHEHYVQQDVELRLLPSACPERGGGAGGAGLHFAGHRRREEGPAPTGSRPRGAADQELELLRECLGAAVPARLRKVASALVPGRRALPVPVYMLVPAPAPAQEDDSCTDSAEGTPVNFSSAASLSDETLQGPPRDQPGGPAGRQRPTGRPTSARQAMGHRHKAGGAGRSAEQSRGAGKNRAGLELPLGRPPSAPADKDGSKPGRTRGDGALQSLCLTTPTEEAVYCFYGNDSDEEPPAAAPTPTHRRTSAIPRAFTRERPQGRKEAPAPSKAAPAAPPPARTQPSLIADETPPCYSLSSSASSLSEPEPSEPPAVHPRGREPAVTKDPGPGGGRDSSPSPRAAEELLQRCISSALPRRRPPVSGLRRRKPRATRLDERPAEGSRERGEEAAGSDRASDLDSVEWRAIQEGANSIVTWLHQAAAATREASSESDSILSFVSGLSVGSTLQPPKHRKGRQAEGEMGSARRPEKRGAASVKTSGSPRSPAGPEKPRGTQKTTPGVPAVLRGRTVIYVPSPAPRAQPKGTPGPRATPRKVAPPCLAQPAAPAKVPSPGQQRSRSLHRPAKTSELATLSQPPRSATPPARLAKTPSSSSSQTSPASQPLPRKRPPVTQAAGALPGPGASPVPKTPARTLLAKQHKTQRSPVRIPFMQRPARRGPPPLARAVPEPGPRGRAGTEAGPGARGGRLGLVRVASALSSGSESSDRSGFRRQLTFIKESPGLRRRRSELSSAESAASAPQGASPRRGRPALPAVFLCSSRCEELRAAPRQGPAPARQRPPAARPSPGERPARRTTSESPSRLPVRAPAARPETVKRYASLPHISVARRPDGAVPAAPASADAARRSSDGEPRPLPRVAAPGTTWRRIRDEDVPHILRSTLPATALPLRGSTPEDAPAGPPPRKTSDAVVQTEEVAAPKTNSSTSPSLETREPPGAPAGGQLSLLGSDVDGPSLAKAPISAPFVHEGLGVAVGGFPASRHGSPSRSARVPPFNYVPSPMVVAATTDSAAEKAPATASATLLE

SEQ ID NO: 851783 - protein, 676 aa, Homo sapiens
APSGLNVAAASANGRRGKRMASARKASRPMRDVFGDFSDVSLEDSTMEEIRNFQISRNLTKIAPGHSRFLKRNQTLDEKHLLLKENPVLGSGPRLASCRPPTTASRIRANAALMKLAQLETRIMNRKLQRNLSDTESDSMTADAGLPKRADRILSGGALELASQNTDKTSQNQARELPVTENNAQNAKVSRFLKKKQAPVENISPEAPAGKERTLQTPKQKEPARTFDSPDSDEEEMKVLLGSLMDSSREKNTNQGFSSANVSEEEERKLFSVPSQLRAFTVPSVELSSAKPSQTSHLPTSLAADRTLHSTRSRADYPQSHVSSDTASHTPSVSITGAFSNSVSLKMGHVKLVSSPGRSEAETVDEPVSEGADDSLDEFRINILSLDGLAPAVSENSDLEQEEESAQRQKTAGKIFRAEASTGQDAPRQAQARSWASQGKAASAEGDESEVSEHLSASSASAIQQDSTSSMQPPSEAPMVNTVSSAYSEDFENSPSLTASEPTAHSKESLDRTLDALSESSSSVKTDLPQTAESRKKSGRHVTRVLVKDTAVQTPDPAFTYEWTKVASMAAMGPALGGAYVDPTPIANHVISADAIEALTAYSPAVLALHDVLKQQLSLTQQFIQASRHLHASLLRSLDADSFHYHTLEEAKEYIRCHRPAPLTMEDALEEVNKEL

SEQ ID NO: 851784 - protein, 676 aa, Homo sapiens; identical to SEQ ID NO: 851783

SEQ ID NO: 851785 - protein, 676 aa, Homo sapiens; identical to SEQ ID NO: 851783

SEQ ID NO: 851786 - protein, 644 aa, Homo sapiens
APSGLNVAAASANGRRGKRMASARKASRPMRDVFGDFSDVSLEDSTMEEIRNFQISRNLTKIAPGHSRFLKRNQTLDEKHLLLKENPVLGSGPRLASCRPPTTASRIRANAALMKLAQLETRIMNRKLQRNLSDTESDSMTADAGLPKRADRILSGGALELASQNTDKTSQNQARELPVTENNAQNAKVSRFLKKKQAPVENISPEAPAGKERTLQTPKQKEPARTFDSPDSDEEEMKVLLGSLMDSSREKNTNQGFSSANVSEEEERKLFSVPSQLRAFTVPSVELSSAKPSQTSHLPTSLAADRTLHSTRSRADYPQSHVSSDTASHTPSVSITGAFSNSVSLKMGHVKLVSSPGRSEAETVDEPVSEGADDSLDEFRINILSLDGLAPAVSENSDLEQEEESAQRQKTAGKIFRAEASTGQDAPRQAQARSWASQGKAASAEGDESEVSEHLSASSASAIQQDSTSSMQPPSEAPMVNTVSSAYSEDFENSPSLTASEPTAHSKESLDRTLDALSESSSSVKTDLPQTAESRKKSGRHVTRVLVKDTAVQTPDPAFTYEWTKALTAYSPAVLALHDVLKQQLSLTQQFIQASRHLHASLLRSLDADSFHYHTLEEAKEYIRCHRPAPLTMEDALEEVNKEL

SEQ ID NO: 851787 - protein, 1341 aa, Homo sapiens
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEEASAESEDEMIHPEGVASLLPPDFQSSLERPELELSRHSPRKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPPVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTVEEKEEVTMDTSENRPENDVPEPPMPIADQVSNDDRPEGSVEDEEKKESSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 851788 - protein, 119 aa, Homo sapiens
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGVRSRRCWGVGGERTR

SEQ ID NO: 851789 - protein, 792 aa, Homo sapiens
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEGKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPPVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTVEEKEEVTMDTSENRPENDVPEPPMPIADQVSNDDRPEGSVEDEEKKEYLMYGNPPVKYNPAQLANR

SEQ ID NO: 851790 - protein, 583 aa, Homo sapiens
MLSESKEGEEKEEVTMDTSENRPENDVPEPPMPIADQVSNDDRPEGSVEDEEKKESSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 851791 - protein, 614 aa, Homo sapiens
MSPADRCRSANTIEPATTSSLALFLLLQRDQSSRTRGLPEEKEEVTMDTSENRPENDVPEPPMPIADQVSNDDRPEGSVEDEEKKESSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 851792 - protein, 800 aa, Homo sapiens
MSSGLWQSPYGLSPGWRGNSKTLLELPAVAGKSKDLLGDNLPFIKTFLIKDTFEFFLLALAQEPHLQWVWCCPFPQCGGGLGSLDMTVCCPSISKPLSVGISLAIEERRVTLLKLPSKVGFPCFLELARKDLGGLDDPVWGTVCLAWCPLDSDGERGGMTNIFEGAERLLNSSSSLFLVKLIHRCDTEYMTFPCSDDLVLFFSLTCIDSASFLPFAASVLVSVCLCVSLCLSLSLYAVSLEAKLRLPHLTSFPPLCGVSLFLFFFPFFFFIQSSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 851793 - protein, 844 aa, Homo sapiens
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEEASAESEDEMIHPEGVASLLPPDFQSSLERPELELSRHSPRKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPPVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTVEEKEEVTMDTSENRPENDVPEPPMPIADQVSNDDRPEGSVEDEEKKEVNIQATYWGGWAGMDLGERVEHSSDPSYTVG

SEQ ID NO: 851794 - protein, 543 aa, Homo sapiens
MSLFLFFFPFFFFIQSSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 851795 - protein, 517 aa, Homo sapiens
MGTAATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 851796 - protein, 505 aa, Homo sapiens
MGTAATKGVPAGNSDTEGGQPGRKRRWGASTATTQKKPSISITTESLKEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 851797 - protein, 483 aa, Homo sapiens
MGPVYTGWGVSVSQSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 851798 - protein, 2498 aa, Homo sapiens
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEEASAESEDEMIHPEGVASLLPPDFQSSLERPELELSRHSPRKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPPVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTVEEKEEVTMDTSENRPENDVPEPPMPIADQVSNDDRPEGSVEDEEKKEVNIQATYWGGWAGMDLGERVEHSSDPSYTVGELKGGMRQGLGSERAKGEFAGLARETPCDGDRAHSFSFPCWGSSAQTLDVCNYTGKSDNGPLSKIYVQLFLLSSQASPGGNSFSFPSFLKADGAQRHLVDIGGSHQTSHAEKFLFLLCPPVVWLQRCSYLEASTCDPEGPFSVTCDPSTSFFGICYLVSCTHFRGLPPSEPAKSSWLLKKLRKNELGLGEGEQGGRDCCVCSLFLVCVAGVGAGESDLMLQNIIYYKVLLPRKTLSKYLMYGNPPVKYNPAQLANRWCRLFLWTHPLLLSCPIRAKSAIQVSWPEGGMYMGSCDGPPFASLSCLHQGAKKNTVLERLVLSKQKTFGKGWTCIISLLGTPQEELVPVLGRLPTCPCPFEDCGLPCLLQTVGIPIYGHQDLLKFVIAVPCCKTLSGTLYLSCDDYGTVQRSLGSEPLGIYADDSPAHVSPLAHQMDFPLVPVVHGEGQHVGCSNFSSIPGGRDSFHPPDWNHCLSWSSLRRCQPQLSEEKYSDLAAECLPGPGVFTYPQATFIRGSMIPLGERTPSPVTGRGERDSGVITWIPSIGWCYCCSLPLVDIGSCLPLTIKGKDHSCYSQPSHQGLQDDVPSGPGLMSLPLSPLYPSLSLATASELSVTSWKLGSVPPHVSLPPPLRPWEDSGSAVLTTTPCAHLFCQPNPPPIAQRLAGRAHSDLDRRLTRYSPHSEVRLAELKIPGVDGTWNICHIPSLFSSLFSSSFFNILFYFFSISLFFLISFIYLFGHVFPVLIKTFFFVLFFSLTYPSRAAQLGVRLALNRDQGDLVRRHKRGCGWGWMGKGFHHEVSALPFRRVESGLSFSRNKHLHLKILYSLFLSHFSPPPPIVFRHSPTECLGYRLVPKMSSGLWQSPYGLSPGWRGNSKTLLELPAVAGKSKDLLGDNLPFIKTFLYQRTFEFFLLALAQEPHLQWVWCCPFPQCGGGLGSLDMTVCCPSISKPLSVGISLAIEERRVTLLKLPSKVGFPCFLELARKDLGGLDDPVWGTVCLAWCPLDSDGERGGMTNIFEGAERLLNSSSSLFLVKLIHRCDTEYMTFPCSDDLVLFFSLTCIDVCFVFAVCRFCFGLCLSLCLSLSLSLTLSVSLEAKLRLPHLTSFPPLCGVSLFLFFFPFFFFIQSSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 851799 - protein, 189 aa, Homo sapiens
MERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 851800 - protein, 189 aa, Homo sapiens; identical to SEQ ID NO: 851799

SEQ ID NO: 851801 - protein, 132 aa, Homo sapiens
MLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 851802 - protein, 844 aa, Homo sapiens; identical to SEQ ID NO: 851793

SEQ ID NO: 851803 - protein, 766 aa, Homo sapiens
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEEASAESEDEMIHPEGVASLLPPDFQSSLERPELELSRHSPRKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPPVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTV

SEQ ID NO: 851804 - protein, 722 aa, Homo sapiens
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEEASAESEDEMIHPEGVASLLPPDFQSSLERPELELSRHSPRKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPPVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKEKAGRRPKSSSVYILVFSFSCPRGYTEGTLSPPKHIGAGLLWPGAWHSCS

SEQ ID NO: 851805 - protein, 832 aa, Homo sapiens
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEEASAESEDEMIHPEGVASLLPPDFQSSLERPELELSRHSPRKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPPVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTVEEKEEVTMDTSENRPENDVPEPPMPIADQVSNDDRPEGSVEDEEKKEYLMYGNPPVKYNPAQLANR

SEQ ID NO: 851806 - protein, 2498 aa, Homo sapiens; identical to SEQ ID NO: 851798

SEQ ID NO: 851807 - protein, 2531 aa, Homo sapiens
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEEASAESEDEMIHPEGVASLLPPDFQSSLERPELELSRHSPRKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPPVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTVEEKEEVTMDTSENRPENDVPEPPMPIADQVSNDDRPEGSVEDEEKKEVNIQATYWGGWAGMDLGERVEHSSDPSYTVGELKGGMRQGLGSERAKGEFAGLARETPCDGDRAHSFSFPCWGSSAQTLDVCNYTGKSDNGPLSKIYVQLFLLSSQASPGGNSFSFPSFLKADGAQRHLVDIGGSHQTSHAEKFLFLLCPPVVWLQRCSYLEASTCDPEGPFSVTCDPSTSFFGICYLVSCTHFRGLPPSEPAKSSWLLKKLRKNELGLGEGEQGGRDCCVCSLFLVCVAGVGAGESDLMLQNIIYYKVLLPRKTLSKYLMYGNPPVKYNPAQLANRWCRLFLWTHPLLLSCPIRAKSAIQVSWPEGGMYMGSCDGPPFASLSCLHQGAKKNTVLERLVLSKQKTFGKGWTCIISLLGTPQEELVPVLGRLPTCPCPFEDCGLPCLLQTVGIPIYGHQDLLKFVIAVPCCKTLSGTLYLSCDDYGTVQRSLGSEPLGIYADDSPAHVSPLAHQMDFPLVPVVHGEGQHVGCSNFSSIPGGRDSFHPPDWNHCLSWSSLRRCQPQLSEEKYSDLAAECLPGPGVFTYPQATFIRGSMIPLGERTPSPVTGRGERDSGVITWIPSIGWCYCCSLPLVDIGSCLPLTIKGKDHSCYSQPSHQGLQDDVPSGPGLMSLPLSPLYPSLSLATASELSVTSWKLGSVPPHVSLPPPLRPWEDSGSAVLTTTPCAHLFCQPNPPPIAQRLAGRAHSDLDRRLTRYSPHSEVRLAELKIPGVDGTWNICHIPSLFSSLFSSSFFNILFYFFSISLFFLISFIYLFGHVFPVLIKTFFFVLFFSLTYPSRAAQLGVRLALNRDQGDLVRRHKRGCGWGWMGKGFHHEVSALPFRRVESGLSFSRNKHLHLKILYSLFLSHFSPPPPIVFRHSPTECLGYRLVPKMSSGLWQSPYGLSPGWRGNSKTLLELPAVAGKSKDLLGDNLPFIKTFLYQRTFEFFLLALAQEPHLQWVWCCPFPQCGGGLGSLDMTVCCPSISKPLSVGISLAIEERRVTLLKLPSKVGFPCFLELARKDLGGLDDPVWGTVCLAWCPLDSDGERGGMTNIFEGAERLLNSSSSLFLVKLIHRCDTEYMTFPCSDDLVLFFSLTCIDVCFVFAVCRFCFGLCLSLCLSLSLSLTLSVSLEAKLRLPHLTSFPPLCGVSLFLFFFPFFFFIQSSLPKSFKRKISVVSATKGVPAGNSDTEGGQPGRKRRWGASTATTQKKPSISITTESLKVRWEEPGKGEMRPVKVGVDMGPVYTGWGVSVSQSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 851808 - protein, 2633 aa, Homo sapiens
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEEASAESEDEMIHPEGVASLLPPDFQSSLERPELELSRHSPRKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPPVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTVEEKEEVTMDTSENRPENDVPEPPMPIADQVSNDDRPEGSVEDEEKKEVNIQATYWGGWAGMDLGERVEHSSDPSYTVGELKGGMRQGLGSERAKGEFAGLARETPCDGDRAHSFSFPCWGSSAQTLDVCNYTGKSDNGPLSKIYVQLFLLSSQASPGGNSFSFPSFLKADGAQRHLVDIGGSHQTSHAEKFLFLLCPPVVWLQRCSYLEASTCDPEGPFSVTCDPSTSFFGICYLVSCTHFRGLPPSEPAKSSWLLKKLRKNELGLGEGEQGGRDCCVCSLFLVCVAGVGAGESDLMLQNIIYYKVLLPRKTLSKYLMYGNPPVKYNPAQLANRWCRLFLWTHPLLLSCPIRAKSAIQVSWPEGGMYMGSCDGPPFASLSCLHQGAKKNTVLERLVLSKQKTFGKGWTCIISLLGTPQEELVPVLGRLPTCPCPFEDCGLPCLLQTVGIPIYGHQDLLKFVIAVPCCKTLSGTLYLSCDDYGTVQRSLGSEPLGIYADDSPAHVSPLAHQMDFPLVPVVHGEGQHVGCSNFSSIPGGRDSFHPPDWNHCLSWSSLRRCQPQLSEEKYSDLAAECLPGPGVFTYPQATFIRGSMIPLGERTPSPVTGRGERDSGVITWIPSIGWCYCCSLPLVDIGSCLPLTIKGKDHSCYSQPSHQGLQDDVPSGPGLMSLPLSPLYPSLSLATASELSVTSWKLGSVPPHVSLPPPLRPWEDSGSAVLTTTPCAHLFCQPNPPPIAQRLAGRAHSDLDRRLTRYSPHSEVRLAELKIPGVDGTWNICHIPSLFSSLFSSSFFNILFYFFSISLFFLISFIYLFGHVFPVLIKTFFFVLFFSLTYPSRAAQLGVRLALNRDQGDLVRRHKRGCGWGWMGKGFHHEVSALPFRRVESGLSFSRNKHLHLKILYSLFLSHFSPPPPIVFRHSPTECLGYRLVPKMSSGLWQSPYGLSPGWRGNSKTLLELPAVAGKSKDLLGDNLPFIKTFLYQRTFEFFLLALAQEPHLQWVWCCPFPQCGGGLGSLDMTVCCPSISKPLSVGISLAIEERRVTLLKLPSKVGFPCFLELARKDLGGLDDPVWGTVCLAWCPLDSDGERGGMTNIFEGAERLLNSSSSLFLVKLIHRCDTEYMTFPCSDDLVLFFSLTCIDVCFVFAVCRFCFGLCLSLCLSLSLSLTLSVSLEAKLRLPHLTSFPPLCGVSLFLFFFPFFFFIQSSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVSHCFSPSQLAEWLSLSFRLMPPRFHSELNWSTNRLSYSLILSELLNIFTHLKMRGKSCCPAGLFRGLAEGLTYNVSISAGKHHQLFSHSYCKVPKLSALPQTLKLYSCDSSSGNLKIGWWSCLLLDLKVYFHWQVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 851809 - protein, 2619 aa, Homo sapiens
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEEASAESEDEMIHPEGVASLLPPDFQSSLERPELELSRHSPRKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPPVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTVEEKEEVTMDTSENRPENDVPEPPMPIADQVSNDDRPEGSVEDEEKKEVNIQATYWGGWAGMDLGERVEHSSDPSYTVGELKGGMRQGLGSERAKGEFAGLARETPCDGDRAHSFSFPCWGSSAQTLDVCNYTGKSDNGPLSKIYVQLFLLSSQASPGGNSFSFPSFLKADGAQRHLVDIGGSHQTSHAEKFLFLLCPPVVWLQRCSYLEASTCDPEGPFSVTCDPSTSFFGICYLVSCTHFRGLPPSEPAKSSWLLKKLRKNELGLGEGEQGGRDCCVCSLFLVCVAGVGAGESDLMLQNIIYYKVLLPRKTLSKYLMYGNPPVKYNPAQLANRWCRLFLWTHPLLLSCPIRAKSAIQVSWPEGGMYMGSCDGPPFASLSCLHQGAKKNTVLERLVLSKQKTFGKGWTCIISLLGTPQEELVPVLGRLPTCPCPFEDCGLPCLLQTVGIPIYGHQDLLKFVIAVPCCKTLSGTLYLSCDDYGTVQRSLGSEPLGIYADDSPAHVSPLAHQMDFPLVPVVHGEGQHVGCSNFSSIPGGRDSFHPPDWNHCLSWSSLRRCQPQLSEEKYSDLAAECLPGPGVFTYPQATFIRGSMIPLGERTPSPVTGRGERDSGVITWIPSIGWCYCCSLPLVDIGSCLPLTIKGKDHSCYSQPSHQGLQDDVPSGPGLMSLPLSPLYPSLSLATASELSVTSWKLGSVPPHVSLPPPLRPWEDSGSAVLTTTPCAHLFCQPNPPPIAQRLAGRAHSDLDRRLTRYSPHSEVRLAELKIPGVDGTWNICHIPSLFSSLFSSSFFNILFYFFSISLFFLISFIYLFGHVFPVLIKTFFFVLFFSLTYPSRAAQLGVRLALNRDQGDLVRRHKRGCGWGWMGKGFHHEVSALPFRRVESGLSFSRNKHLHLKILYSLFLSHFSPPPPIVFRHSPTECLGYRLVPKMSSGLWQSPYGLSPGWRGNSKTLLELPAVAGKSKDLLGDNLPFIKTFLYQRTFEFFLLALAQEPHLQWVWCCPFPQCGGGLGSLDMTVCCPSISKPLSVGISLAIEERRVTLLKLPSKVGFPCFLELARKDLGGLDDPVWGTVCLAWCPLDSDGERGGMTNIFEGAERLLNSSSSLFLVKLIHRCDTEYMTFPCSDDLVLFFSLTCIDVCFVFAVCRFCFGLCLSLCLSLSLSLTLSVSLEAKLRLPHLTSFPPLCGVSLFLFFFPFFFFIQSSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKGEVTYCERNVMRLPEFSEHLIWIAESFECFLPFIIFFRISYLSPTYEVSYLRARFDSVESLNLHDEEVSLAQYFADYEVLCTFRLRSGCLVEKKGNRESYIEGEKSQYCFLPKAVLVVFLIVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 851810 - protein, 583 aa, Homo sapiens; identical to SEQ ID NO: 851790

SEQ ID NO: 851811 - protein, 613 aa, Homo sapiens
PPLLQQGPPPSAHTGCWKGINSTSRGRKKIMLSESKEGEEKEEVTMDTSENRPENDVPEPPMPIADQVSNDDRPEGSVEDEEKKESSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 851812 - protein, 596 aa, Homo sapiens
LVLDRELELVLPESERIHHTVEEKEEVTMDTSENRPENDVPEPPMPIADQVSNDDRPEGSVEDEEKKESSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 851813 - protein, 537 aa, Homo sapiens
MSPADRCRSANTIEPATTSSLALFLLLQRDQSSRTRGLPVRTYRLSLKTSTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 851814 - protein, 343 aa, Homo sapiens
PNNQLRTPSVRSDSYICMRITVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 851815 - protein, 189 aa, Homo sapiens; identical to SEQ ID NO: 851799

SEQ ID NO: 851816 - protein, 2498 aa, Homo sapiens; identical to SEQ ID NO: 851798

SEQ ID NO: 851817 - protein, 844 aa, Homo sapiens; identical to SEQ ID NO: 851793

SEQ ID NO: 851818 - protein, 765 aa, Homo sapiens
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEEASAESEDEMIHPEGVASLLPPDFQSSLERPELELSRHSPRKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPPVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTLDSSARFLVVTA

SEQ ID NO: 851819 - protein, 391 aa, Homo sapiens
LSCIMVRSVAWAGFMVLLMIPWGSAAKLVCYFTNWAQYRQGEARFLPKDLDPSLCTHLIYAFAGMTNHQLSTTEWNDETLYQEFNGLKKMNPKLKTLLAIGGWNFGTQKFTDMVATANNRQTFVNSAIRFLRKYSFDGLDLDWEYPGSQGSPAVDKERFTTLVQDLANAFQQEAQTSGKERLLLSAAVPAGQTYVDAGYEVDKIAQNLDFVNLMAYDFHGSWEKVTGHNSPLYKRQEESGAAASLNVDAAVQQWLQKGTPASKLILGMPTYGRSFTLASSSDTRVGAPATGSGTPGPFTKEGGMLAYYEVCSWKGATKQRIQDQKVPYIFRDNQWVGFDDVESFKTKVSYLKQKGLGGAMVWALDLDDFAGFSCNQGRYPLIQTLRQELNG

SEQ ID NO: 851820 - protein, 451 aa, Homo sapiens
LSCIMVRSVAWAGFMVLLMIPWGSAAKLVCYFTNWAQYRQGEARFLPKDLDPSLCTHLIYAFAGMTNHQLSTTEWNDETLYQEFNGLKKMFTDMVATANNRQTFVNSAIRFLRKYSFDGLDLDWEYPGSQGSPAVDKERFTTLVQDLANAFQQEAQTSGKERLLLSAAVPAGQTYVDAGYEVDKIAQNLDFVNLMAYDFHGSWEKVTGHNSPLYKRQEESGAAASLNVDAAVQQWLQKGTPASKLILGMPTYGRSFTLASSSDTRVGAPATGSGTPGPFTKEGGMLAYYEVCSWKGATKQRIQDQKVPYIFRDNQWVGFDDVESFKTKVSYLKQKGLGGAMVWALDLDDFAGFSCNQGRYPLIQTLRQELSLPYLPSGTPELEVPKPGQPSEPEHGPSPGQDTFCQGKADGLYPNPRERSSFYSCAAGRLFQQSCPTGLVFSNSCKCCTWN

SEQ ID NO: 851821 - protein, 470 aa, Homo sapiens
LSCIMVRSVAWAGFMVLLMIPWGSAAKLVCYFTNWAQYRQGEARFLPKDLDPSLCTHLIYAFAGMTNHQLSTTEWNDETLYQEFNGLKKMNPKLKTLLAIGGWNFGTQKFTDMVATANNRQTFVNSAIRFLRKYSFDGLDLDWEYPGSQGSPAVDKERFTTLVQDLANAFQQEAQTSGKERLLLSAAVPAGQTYVDAGYEVDKIAQNLDFVNLMAYDFHGSWEKVTGHNSPLYKRQEESGAAASLNVDAAVQQWLQKGTPASKLILGMPTYGRSFTLASSSDTRVGAPATGSGTPGPFTKEGGMLAYYEVCSWKGATKQRIQDQKVPYIFRDNQWVGFDDVESFKTKVSYLKQKGLGGAMVWALDLDDFAGFSCNQGRYPLIQTLRQELSLPYLPSGTPELEVPKPGQPSEPEHGPSPGQDTFCQGKADGLYPNPRERSSFYSCAAGRLFQQSCPTGLVFSNSCKCCTWN

SEQ ID NO: 851822 - protein, 99 aa, Homo sapiens
RLPAQGCLQNLQPLTGLRLLEQKGPCPEEVARLWGGRVRLPRAPPLHPLPAQVSYLKQKGLGGAMVWALDLDDFAGFSCNQGRYPLIQTLRQELSAEIT

SEQ ID NO: 851823 - protein, 446 aa, Homo sapiens
LSCIMVRSVAWAGFMVLLMIPWGSAAKLVCYFTNWAQYRQGEARFLPKDLDPSLCTHLIYAFAGMTNHQLSTTEWNDETLYQEFNGLKKMNPKLKTLLAIGGWNFGTQKFTDMVATANNRQTFVNSAIRFLRKYSFDGLDLDWEYPGSQGSPAVDKERFTTLVQDLANAFQQEAQTSGKERLLLSAAVPAGQTYVDAGYEVDKIAQNLDFVNLMAYDFHGSWEKVTGHNSPLYKRQEESGAAASLNVDAAVQQWLQKGTPASKLILGMPTYGRSFTLASSSDTRVGAPATGSGTPGPFTKEGGMLAYYEVCSWKGATKQRIQDQKVPYIFRDNQWVGFDDVESFKTKVSYLKQKGLGGAMVWALDLDDFAGFSCNQGRYPLIQTLRQELSWSAEARSQLTAALTSWAQLILPPQPPRCRNHLEDFQTEVLFHDKSTTLPSPSIEYH

SEQ ID NO: 851824 - protein, 1403 aa, Homo sapiens
MATQQKASDERISQFDHNLLPELSALLGLDAVQLAKELEEEEQKERAKMQKGYNSQMRSEAKRLKTFVTYEPYSSWIPQEMAAAGFYFTGVKSGIQCFCCSLILFGAGLTRLPIEDHKRFHPDCGFLLNKDVGNIAKYDIRVKNLKSRLRGGKMRYQEEEARLASFRNWPFYVQGISPCVLSEAGFVFTGKQDTVQCFSCGGCLGNWEEGDDPWKEHAKWFPKCEFLRSKKSSEEITQYIQSYKGFVDITGEHFVNSWVQRELPMASAYCNDSIFAYEELRLDSFKDWPRESAVGVAALAKAGLFYTGIKDIVQCFSCGGCLEKWQEGDDPLDDHTRCFPNCPFLQNMKSSAEVTPDLQSRGELCELLETTSESNLEDSIAVGPIVPEMAQGEAQWFQEAKNLNEQLRAAYTSASFRHMSLLDISSDLATDHLLGCDLSIASKHISKPVQEPLVLPEVFGNLNSVMCVEGEAGSGKTVLLKKIAFLWASGCCPLLNRFQLVFYLSLSSTRPDEGLASIICDQLLEKEGSVTEMCMRNIIQQLKNQVLFLLDDYKEICSIPQVIGKLIQKNHLSRTCLLIAVRTNRARDIRRYLETILEIKAFPFYNTVCILRKLFSHNMTRLRKFMVYFGKNQSLQKIQKTPLFVAAICAHWFQYPFDPSFDDVAVFKSYMERLSLRNKATAEILKATVSSCGELALKGFFSCCFEFNDDDLAEAGVDEDEDLTMCLMSKFTAQRLRPFYRFLSPAFQEFLAGMRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFPIRGNKTSPRAHFSVLETCFDKSQVPTIDQDYASAFEPMNEWERNLAEKEDNVKSYMDMQRRASPDLSTGYWKLSPKQYKIPCLEVDVNDIDVVGQDMLEILMTVFSASQRIELHLNHSRGFIESIRPALELSKASVTKCSISKLELSAAEQELLLTLPSLESLEVSGTIQSQDQIFPNLDKFLCLKELSVDLEGNINVFSVIPEEFPNFHHMEKLLIQISAEYDPSKLVKLIQNSPNLHVFHLKCNFFSDFGSLMTMLVSCKKLTEIKFSDSFFQAVPFVASLPNFISLKILNLEGQQFPDEETSEKFAYILGSLSNLEELILPTGDGIYRVAKLIIQQCQQLHCLRVLSFFKTLNDDSVVEIAKVAISGGFQKLENLKLSINHKITEEGYRNFFQALDNMPNLQELDISRHFTECIKAQATTVKSLSQCVLRLPRLIRLNMLSWLLDADDIALLNVMKERHPQSKYLTILQKWILPFSPIIQK

SEQ ID NO: 851825 - protein, 1207 aa, Homo sapiens
PPGKKLCPGFEISEGAPAFFFPLKPGHKNKTFPPKKKKKKKSQIINNLNFNFPQGEHFVNSWVQRELPMASAYCNDSIFAYEELRLDSFKDWPRESAVGVAALAKAGLFYTGIKDIVQCFSCGGCLEKWQEGDDPLDDHTRCFPNCPFLQNMKSSAEVTPDLQSRGELCELLETTSESNLEDSIAVGPIVPEMAQGEAQWFQEAKNLNEQLRAAYTSASFRHMSLLDISSDLATDHLLGCDLSIASKHISKPVQEPLVLPEVFGNLNSVMCVEGEAGSGKTVLLKKIAFLWASGCCPLLNRFQLVFYLSLSSTRPDEGLASIICDQLLEKEGSVTEMCMRNIIQQLKNQVLFLLDDYKEICSIPQVIGKLIQKNHLSRTCLLIAVRTNRARDIRRYLETILEIKAFPFYNTVCILRKLFSHNMTRLRKFMVYFGKNQSLQKIQKTPLFVAAICAHWFQYPFDPSFDDVAVFKSYMERLSLRNKATAEILKATVSSCGELALKGFFSCCFEFNDDDLAEAGVDEDEDLTMCLMSKFTAQRLRPFYRFLSPAFQEFLAGMRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFPIRGNKTSPRAHFSVLETCFDKSQVPTIDQDYASAFEPMNEWERNLAEKEDNVKSYMDMQRRASPDLSTGYWKLSPKQYKIPCLEVDVNDIDVVGQDMLEILMTVFSASQRIELHLNHSRGFIESIRPALELSKASVTKCSISKLELSAAEQELLLTLPSLESLEVSGTIQSQDQIFPNLDKFLCLKELSVDLEGNINVFSVIPEEFPNFHHMEKLLIQISAEYDPSKLVKLIQNSPNLHVFHLKCNFFSDFGSLMTMLVSCKKLTEIKFSDSFFQAVPFVASLPNFISLKILNLEGQQFPDEETSEKFAYILGSLSNLEELILPTGDGIYRVAKLIIQQCQQLHCLRVLSFFKTLNDDSVVEIAKVAISGGFQKLENLKLSINHKITEEGYRNFFQALDNMPNLQELDISRHFTECIKAQATTVKSLSQCVLRLPRLIRLNMLSWLLDADDIALLNVMKERHPQSKYLTILQKWILPFSPIIQK

SEQ ID NO: 851826 - protein, 1191 aa, Homo sapiens
ENLPLHFSLGNRVRLCLKKKKKKKKSQIINNLNFNFPQGEHFVNSWVQRELPMASAYCNDSIFAYEELRLDSFKDWPRESAVGVAALAKAGLFYTGIKDIVQCFSCGGCLEKWQEGDDPLDDHTRCFPNCPFLQNMKSSAEVTPDLQSRGELCELLETTSESNLEDSIAVGPIVPEMAQGEAQWFQEAKNLNEQLRAAYTSASFRHMSLLDISSDLATDHLLGCDLSIASKHISKPVQEPLVLPEVFGNLNSVMCVEGEAGSGKTVLLKKIAFLWASGCCPLLNRFQLVFYLSLSSTRPDEGLASIICDQLLEKEGSVTEMCMRNIIQQLKNQVLFLLDDYKEICSIPQVIGKLIQKNHLSRTCLLIAVRTNRARDIRRYLETILEIKAFPFYNTVCILRKLFSHNMTRLRKFMVYFGKNQSLQKIQKTPLFVAAICAHWFQYPFDPSFDDVAVFKSYMERLSLRNKATAEILKATVSSCGELALKGFFSCCFEFNDDDLAEAGVDEDEDLTMCLMSKFTAQRLRPFYRFLSPAFQEFLAGMRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFPIRGNKTSPRAHFSVLETCFDKSQVPTIDQDYASAFEPMNEWERNLAEKEDNVKSYMDMQRRASPDLSTGYWKLSPKQYKIPCLEVDVNDIDVVGQDMLEILMTVFSASQRIELHLNHSRGFIESIRPALELSKASVTKCSISKLELSAAEQELLLTLPSLESLEVSGTIQSQDQIFPNLDKFLCLKELSVDLEGNINVFSVIPEEFPNFHHMEKLLIQISAEYDPSKLVKLIQNSPNLHVFHLKCNFFSDFGSLMTMLVSCKKLTEIKFSDSFFQAVPFVASLPNFISLKILNLEGQQFPDEETSEKFAYILGSLSNLEELILPTGDGIYRVAKLIIQQCQQLHCLRVLSFFKTLNDDSVVEIAKVAISGGFQKLENLKLSINHKITEEGYRNFFQALDNMPNLQELDISRHFTECIKAQATTVKSLSQCVLRLPRLIRLNMLSWLLDADDIALLNVMKERHPQSKYLTILQKWILPFSPIIQK

SEQ ID NO: 851827 - protein, 1077 aa, Homo sapiens
MASAYCNDSIFAYEELRLDSFKDWPRESAVGVAALAKAGLFYTGIKDIVQCFSCGGCLEKWQEGDDPLDDHTRCFPNCPFLQNMKSSAEVTPDLQSRGELCELLETTSESNLEDSIAVGPIVPEMAQGEAQWFQEAKNLNEQLRAAYTSASFRHMSLLDISSDLATDHLLGCDLSIASKHISKPVQEPLVLPEVFGNLNSVMCVEGEAGSGKTVLLKKIAFLWASGCCPLLNRFQLVFYLSLSSTRPDEGLASIICDQLLEKEGSVTEMCMRNIIQQLKNQVLFLLDDYKEICSIPQVIGKLIQKNHLSRTCLLIAVRTNRARDIRRYLETILEIKAFPFYNTVCILRKLFSHNMTRLRKFMVYFGKNQSLQKIQKTPLFVAAICAHWFQYPFDPSFDDVAVFKSYMERLSLRNKATAEILKATVSSCGELALKGFFSCCFEFNDDDLAEAGVDEDEDLTMCLMSKFTAQRLRPFYRFLSPAFQEFLAGMRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFPIRGNKTSPRAHFSVLETCFDKSQVPTIDQDYASAFEPMNEWERNLAEKEDNVKSYMDMQRRASPDLSTGYWKLSPKQYKIPCLEVDVNDIDVVGQDMLEILMTVFSASQRIELHLNHSRGFIESIRPALELSKASVTKCSISKLELSAAEQELLLTLPSLESLEVSGTIQSQDQIFPNLDKFLCLKELSVDLEGNINVFSVIPEEFPNFHHMEKLLIQISAEYDPSKLVKLIQNSPNLHVFHLKCNFFSDFGSLMTMLVSCKKLTEIKFSDSFFQAVPFVASLPNFISLKILNLEGQQFPDEETSEKFAYILGSLSNLEELILPTGDGIYRVAKLIIQQCQQLHCLRVLSFFKTLNDDSVVEIAFNQSQDYRGRIQKFLSSTGQHAKLAGVGHLQAFHRVYQSSGHNSQVFESMCVTTTKAH

SEQ ID NO: 851828 - protein, 273 aa, Homo sapiens
MEKLLIQISAEYDPSKLVKLIQNSPNLHVFHLKCNFFSDFGSLMTMLVSCKKLTEIKFSDSFFQAVPFVASLPNFISLKILNLEGQQFPDEETSEKFAYILGSLSNLEELILPTGDGIYRVAKLIIQQCQQLHCLRVLSFFKTLNDDSVVEIAKVAISGGFQKLENLKLSINHKITEEGYRNFFQALDNMPNLQELDISRHFTECIKAQATTVKSLSQCVLRLPRLIRLNMLSWLLDADDIALLNVMKERHPQSKYLTILQKWILPFSPIIQK

SEQ ID NO: 851829 - protein, 228 aa, Homo sapiens [sequence omitted]

SEQ ID NO: 851830 - protein, 840 aa, Homo sapiens
MASAYCNDSIFAYEELRLDSFKDWPRESAVGVAALAKAGLFYTGIKDIVQCFSCGGCLEKWQEGDDPLDDHTRCFPNCPFLQNMKSSAEVTPDLQSRGELCELLETTSESNLEDSIAVGPIVPEMAQGEAQWFQEAKNLNEQLRAAYTSASFRHMSLLDISSDLATDHLLGCDLSIASKHISKPVQEPLVLPEVFGNLNSVMCVEGEAGSGKTVLLKKIAFLWASGCCPLLNRFQLVFYLSLSSTRPDEGLASIICDQLLEKEGSVTEMCMRNIIQQLKNQVLFLLDDYKEICSIPQVIGKLIQKNHLSRTCLLIAVRTNRARDIRRYLETILEIKAFPFYNTVCILRKLFSHNMTRLRKFMVYFGKNQSLQKIQKTPLFVAAICAHWFQYPFDPSFDDVAVFKSYMERLSLRNKATAEILKATVSSCGELALKGFFSCCFEFNDDDLAEAGVDEDEDLTMCLMSKFTAQRLRPFYRFLSPAFQEFLAGMRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFPIRGNKTSPRAHFSVLETCFDKSQVPTIDQDYASAFEPMNEWERNLAEKEDNVKSYMDMQRRASPDLSTGYWKLSPKQYKIPCLEVDVNDIDVVGQDMLEILMTVFSASQRIELHLNHSRGFIESIRPALELSKASVTKCSISKLELSAAEQELLLTLPSLESLEVSGTIQSQGIPVYILDDYSDV

SEQ ID NO: 851831 - protein, 268 aa, Homo sapiens
MATQQKASDERISQFDHNLLPELSALLGLDAVQLAKELEEEEQKERAKMQKGYNSQMRSEAKRLKTFVTYEPYSSWIPQEMAAAGFYFTGVKSGIQCFCCSLILFGAGLTRLPIEDHKRFHPDCGFLLNKDVGNIAKYDIRVKNLKSRLRGGKMRYQEEEARLASFRNWPFYVQGISPCVLSEAGFVFTGKQDTVQCFSCGGCLGNWEEGDDPWKEHAKWFPKCEFLRSKKSSEEITQYIQSYKGFVDITGWLLTGSACLPDSLPLYE

SEQ ID NO: 851832 - protein, 243 aa, Homo sapiens
MPLHIGDFVWDSKVHSLQSSLNIFSLLPTKGRTEHLFFSHILSFHWPAFSSIRLELWINLRCEFLRSKKSSEEITQYIQSYKGFVDITGEHFVNSWVQRELPMASAYCNDSIFAYEELRLDSFKDWPRESAVGVAALAKAGLFYTGIKDIVQCFSCGGCLEKWQEGDDPLDDHTRCFPKRSLALSPRLECSGMISAHCRLCLPGSSNSSCLSIPSSWDYRHAPLCLANFCIFNRDGVLPRWPG

SEQ ID NO: 851833 - protein, 1139 aa, Homo sapiens
MASAYCNDSIFAYEELRLDSFKDWPRESAVGVAALAKAGLFYTGIKDIVQCFSCGGCLEKWQEGDDPLDDHTRCFPNCPFLQNMKSSAEVTPDLQSRGELCELLETTSESNLEDSIAVGPIVPEMAQGEAQWFQEAKNLNEQLRAAYTSASFRHMSLLDISSDLATDHLLGCDLSIASKHISKPVQEPLVLPEVFGNLNSVMCVEGEAGSGKTVLLKKIAFLWASGCCPLLNRFQLVFYLSLSSTRPDEGLASIICDQLLEKEGSVTEMCMRNIIQQLKNQVLFLLDDYKEICSIPQVIGKLIQKNHLSRTCLLIAVRTNRARDIRRYLETILEIKAFPFYNTVCILRKLFSHNMTRLRKFMVYFGKNQSLQKIQKTPLFVAAICAHWFQYPFDPSFDDVAVFKSYMERLSLRNKATAEILKATVSSCGELALKGFFSCCFEFNDDDLAEAGVDEDEDLTMCLMSKFTAQRLRPFYRFLSPAFQEFLAGMRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFPIRGNKTSPRAHFSVLETCFDKSQVPTIDQDYASAFEPMNEWERNLAEKEDNVKSYMDMQRRASPDLSTGYWKLSPKQYKIPCLEVDVNDIDVVGQDMLEILMTVFSASQRIELHLNHSRGFIESIRPALELSKASVTKCSISKLELSAAEQELLLTLPSLESLEVSGTIQSQDQIFPNLDKFLCLKELSVDLEGNINVFSVIPEEFPNFHHMEKLLIQISAEYDPSKLVKLIQNSPNLHVFHLKCNFFSDFGSLMTMLVSCKKLTEIKFSDSFFQAVPFVASLPNFISLKILNLEGQQFPDEETSEKFAYILGSLSNLEELILPTGDGIYRVAKLIIQQCQQLHCLRVLSFFKTLNDDSVVEIAKVAISGGFQKLENLKLSINHKITEEGYRNFFQALDNMPNLQELDISRHFTECIKAQATTVKSLSQCVLRLPRLIRLNMLSWLLDADDIALLNVMKERHPQSKYLTILQKWILPFSPIIQK

SEQ ID NO: 851834 - protein, 1403 aa, Homo sapiens; identical to SEQ ID NO: 851824

SEQ ID NO: 851835 - protein, 1139 aa, Homo sapiens; identical to SEQ ID NO: 851833

SEQ ID NO: 851836 - protein, 67 aa, Homo sapiens
CMKTKGPVLTWDPSGRCPVYLFDCLFIYDEPRVLTPDNNATSYWGLRLGFQGAFIAKFLKYFLTASY

SEQ ID NO: 851837 - protein, 231 aa, Homo sapiens
MPLHIGDFVWDSKVHSLQSSLNIFSLLPTKGRTEHLFFSHILSFHWPAFSSIRLELWINLRCEFLRSKKSSEEITQYIQSYKGFVDITGEHFVNSWVQRELPMASAYCNDSIFAYEELRLDSFKDWPRESAVGVAALAKAGLFYTGIKDIVQCFSCGGCLEKWQEGDDPLDDHTRCFPKFSLLPRLECSGAIMAHCSLDLSGSSNLPRSASQVAGTTGTCLHTQLIFFFFF

SEQ ID NO: 851838 - protein, 78 aa, Homo sapiens
AWKHEWLERRNRRGPVVVKPIPVKGDGSEMNHLAAESPGEVQASAASPASKGRRSPSPGNSPKFTFTMKLYLLCDYDS

SEQ ID NO: 851839 - protein, 252 aa, Homo sapiens
QDVGTGTLMAVKQVTYVRNTSSEQEEVVEALREEIRMMSHLNHPNIIRMLGATCEKSNYNLFIEWMAGGSVAHLLSKYGAFKESVVINYTEQLLRGLSYLHENQIIHRDVKGANLLIDSTGQRLRIADFGAAARLASKGTGAGEFQGQLLGTIAFMAPEVLRGQQYGRSCDVWSVGCAIIEMACAKPPWNAEKHSNHLALIFKIASATTAPSIPSHLSPGLRDVALRCLELQPQDRPPSRELLKHPVFRTTW

SEQ ID NO: 851840 - protein, 1454 aa, Homo sapiens
MNKEVSPGVKFFNMSGLGDSSSDPANPDSHKRKGSPCDTLASSTEKRRREQENKYLEELAELLSANISDIDSLSVKPDKCKILKKTVDQIQLMKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQQVQQVQVFADVQCTVNLVGGDPYLNQPGPLGTQKPTSGPQTPQAQQKSLLQQLLTE

SEQ ID NO: 851841 - protein, 1454 aa, Homo sapiens; identical to SEQ ID NO: 851840

SEQ ID NO: 851842 - protein, 1412 aa, Homo sapiens
MNKEVSPGVKFFNMSGLGDSSSDPANPDSHKRKGSPCDTLASSTEKRRREQENKYLEELAELLSANISDIDSLSVKPDKCKILKKTVDQIQLMKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQDKKTEEFFSVVTTD

SEQ ID NO: 851843 - protein, 897 aa, Homo sapiens [sequence omitted]

SEQ ID NO: 851844 - protein, 610 aa, Homo sapiens
KPSLNLLKEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQDKKTEEFFSVVTTD

SEQ ID NO: 851845 - protein, 1290 aa, Homo sapiens
MKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQDKKTEEFFSVVTTD

SEQ ID NO: 851846 - protein, 1332 aa, Homo sapiens
MKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQQVQQVQVFADVQCTVNLVGGDPYLNQPGPLGTQKPTSGPQTPQAQQKSLLQQLLTE

SEQ ID NO: 851847 - protein, 416 aa, Homo sapiens
MEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQDKKTEEFFSVVTTD

SEQ ID NO: 851848 - protein, 1454 aa, Homo sapiens; identical to SEQ ID NO: 851840

SEQ ID NO: 851849 - protein, 1454 aa, Homo sapiens; identical to SEQ ID NO: 851840

SEQ ID NO: 851850 - protein, 1362 aa, Homo sapiens
MKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQQVQQVQVFADVQCTVNLVGGDPYLNQPGPLGTQKPTSGPQTPQAQQKSLLQQLLTE

SEQ ID NO: 851851 - protein, 748 aa, Homo sapiens
MQDFEENSRSGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQDKKTEEFFSVVTTD

SEQ ID NO: 851852 - protein, 601 aa, Homo sapiens
RPLQHQNGNCAAFSSVGSELIKLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQDKKTEEFFSVVTTD

SEQ ID NO: 851853 - protein, 1320 aa, Homo sapiens
MKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQDKKTEEFFSVVTTD

SEQ ID NO: 851854 - protein, 799 aa, Homo sapiens
MKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNSMFWGQHLILNV

SEQ ID NO: 851855 - protein, 111 aa, Homo sapiens
FDSLLDKKITSVAPAAGKAACRCPHRSCTEETTWQVAARPAESLVAQCLLPCMFYSKQAAFRNNHVEWPLNDTWSENFMESNVHPPFFSHCFFLFDVALRKLTLSHNRRQW

SEQ ID NO: 851856 - protein, 106 aa, Homo sapiens
MVNVPKTRRTFCKKCGKHQPHKVTQYKKGKDSLYAQGRRRYDRKQSGYGGQTKPIFRKKAKTTKKIVLRLECVEPNCRSKRMLAIKRCKHFELGGDKKRKGQVIQF

SEQ ID NO: 851857 - protein, 106 aa, Homo sapiens; identical to SEQ ID NO: 851856

SEQ ID NO: 851858 - protein, 106 aa, Homo sapiens; identical to SEQ ID NO: 851856

SEQ ID NO: 851859 - protein, 133 aa, Homo sapiens
LVLDRERPGVGRCFSFSSYRQNSPAAKMVNVPKTRRTFCKKCGKHQPHKVTQYKKGKDSLYAQGRRRYDRKQSGYGGQTKPIFRKKAKTTKKIVLRLECVEPNCRSKRMLAIKRCKHFELGGDKKRKGQVIQF

SEQ ID NO: 851860 - protein, 106 aa, Homo sapiens; identical to SEQ ID NO: 851856

SEQ ID NO: 851861 - protein, 106 aa, Homo sapiens; identical to SEQ ID NO: 851856

SEQ ID NO: 851862 - protein, 106 aa, Homo sapiens; identical to SEQ ID NO: 851856

SEQ ID NO: 851863 - protein, 106 aa, Homo sapiens; identical to SEQ ID NO: 851856

SEQ ID NO: 851864 - protein, 106 aa, Homo sapiens; identical to SEQ ID NO: 851856

SEQ ID NO: 851865 - protein, 133 aa, Homo sapiens; identical to SEQ ID NO: 851859

SEQ ID NO: 851866 - protein, 106 aa, Homo sapiens; identical to SEQ ID NO: 851856

SEQ ID NO: 851867 - protein, 31 aa, Homo sapiens
MALAGLSSRAGFSLQEKGLRHGGYRIAGRAG

SEQ ID NO: 851868 - protein, 142 aa, Homo sapiens
MEMDGDPYNLPAQGQGNIIITKYEQGHRAGAAVDLGHEQVDVRKYTNNLGIVHEMELPRVSALEVKQRRKESKRTNKWQKMLADWTKYRSTKKLSQRVYKVIPLAVRGRAWSLLLDIDRIKSQNPGKYKVSPSHTQLGVQTS

SEQ ID NO: 851869 - protein, 541 aa, Homo sapiens
METDLAEMPEKGALSSQDSPHFQEKSTEEGEVAALRLTARSQETVTFKDVAMDFTPEEWGKLDPAQRDVMLENYRNLVSLWLPVSKPESYNLENGKEPLKLERKAPKSSYSELPFCCSTENEGNLHFQCLSDMETRPQSKDSTSVQDFSKAESCKVAIIDRLTRNSVYDSNLEAALECENWLENQQGNQERHLREMFTHMNSLSEETDHKHDVYWKSFNQKSVLITEDRVPKGSYAFHTLEKSLKQKSNLMKKQRTYKEKKPHKCNDCGELFTYHSVLIRHQRVHTGEKPYTCNECGKSFSHRANLTKHQRTHTRILFECSECKKTFTESSSLATHQRIHVGERPYECNECGKGFNRSTHLVQHQLIHTGVKPYECNECDKAFIHSSALIKHQRTHTGEKPYKCQECGKAFSHCSSLTKHQRVHTGEKPYECSECGKTFSQSTHLVQHQRIHTGEKPYECNECGKTFSRSSNFAKHQRIHIGKKPYKCSECGKAFIHSSALIQHQRTHTGEKPFRCNECGKSFKCSSSLIRHQRVHTEEQP

SEQ ID NO: 851870 - protein, 120 aa, Homo sapiens [sequence omitted]

SEQ ID NO: 851871 - protein, 475 aa, Homo sapiens
MEMDGDPYNLPAQGQGNIIITKYEQGHRAGAAVDLGHEQVDVRKYTNNLGIVHEMELPRVSALEVKQRRKESKRTNKWQKMLADWTKYRSTKKLSQRVYKVIPLAVRGRAWSLLLDIDRIKSQNPGKYKVMKEKGKRSSRIIHCIQLDVSHTLQKHMMFIQRFGVKQQELCDILVAYSAYNPEVGYHRDLSRITAILLLCLPEEDAFWALTQLLAGERHSLWYSTAQILPGSRGSYRIQEQVLHKSFPKIMRHLGKEGLCIEGSMLTRLLRCFLDGKSFGLTLRLWDVFILEGARVLTAMVHASFKIHRKHLMKLSWSTVWEFQERLSQSWALEDNAVLRNLQTSMKELTKKHWDLPPPGSLLQNAHCYTIAWGLQSKAGKDSCTSRASGDFHAHPSQKALLNPGCHLPAQKRRNEGQPAADQSQKEMKCECMAFLTPRQNFGHKARLQLWPLTWTRDAPMQAGVPWLLLTPSGS

SEQ ID NO: 851872 - protein, 345 aa, Homo sapiens
MKEKGKRSSRIIHCIQLDVSHTLQKHMMFIQRFGVKQQELCDILVAYSAYNPEVGYHRDLSRITAILLLCLPEEDAFWALTQLLAGERHSLWYSTAQILPGSRGSYRIQEQVLHKSFPKIMRHLGKEGLCIEGSMLTRLLRCFLDGKSFGLTLRLWDVFILEGARVLTAMVHASFKIHRKHLMKLSWSTVWEFQERLSQSWALEDNAVLRNLQTSMKELTKKHWDLPPPGSLLQNAHCYTIAWGLQSKAGKDSCTSRASGDFHAHPSQKALLNPGCHLPAQKRRNEGQPAADQSQKEMKCECMAFLTPRQNFGHKARLQLWPLTWTRDAPMQAGVPWLLLTPSGS

SEQ ID NO: 851873 - protein, 87 aa, Homo sapiens
LAKEVRPLCEARDGRCPVPPGTASSGRDRHLRTQPQGCCPRASRLQRRRTEADSTLCLPRILPISKRRAQKREKWLLCASRPDPRKQ

SEQ ID NO: 851874 - protein, 92 aa, Homo sapiens
LAKEVRPLCEARDGRCPVPPGTASSGRDRHLRTQPQGCCPRASRLQRRRTEADSTVRKRPDLTQAFHQSPGGKAGSGTTRPGGLLTRLAREI

SEQ ID NO: 851875 - protein, 523 aa, Homo sapiens
WPKKFVPFVRPGMGALSSQDSPHFQEKSTEEGEVAALRLTARSQETVTFKDVAMDFTPEEWGKLDPAQRDVMLENYRNLVSLWLPVSKPESYNLENGKEPLKLERKAPKSSYSDMETRPQSKDSTSVQDFSKAESCKVAIIDRLTRNSVYDSNLEAALECENWLENQQGNQERHLREMFTHMNSLSEETDHKHDVYWKSFNQKSVLITEDRVPKGSYAFHTLEKSLKQKSNLMKKQRTYKEKKPHKCNDCGELFTYHSVLIRHQRVHTGEKPYTCNECGKSFSHRANLTKHQRTHTRILFECSECKKTFTESSSLATHQRIHVGERPYECNECGKGFNRSTHLVQHQLIHTGVKPYECNECDKAFIHSSALIKHQRTHTGEKPYKCQECGKAFSHCSSLTKHQRVHTGEKPYECSECGKTFSQSTHLVQHQRIHTGEKPYECNECGKTFSRSSNFAKHQRIHIGKKPYKCSECGKAFIHSSALIQHQRTHTGEKPFRCNECGKSFKCSSSLIRHQRVHTEEQP

SEQ ID NO: 851876 - protein, 521 aa, Homo sapiens
METDLAEMPEKGALSSQDSPHFQEKSTEEGEVAALRLTARSQETVTFKDVAMDFTPEEWGKLDPAQRDVMLENYRNLVSLWLPVSKPESYNLENGKEPLKLERKAPKSSYSDMETRPQSKDSTSVQDFSKAESCKVAIIDRLTRNSVYDSNLEAALECENWLENQQGNQERHLREMFTHMNSLSEETDHKHDVYWKSFNQKSVLITEDRVPKGSYAFHTLEKSLKQKSNLMKKQRTYKEKKPHKCNDCGELFTYHSVLIRHQRVHTGEKPYTCNECGKSFSHRANLTKHQRTHTRILFECSECKKTFTESSSLATHQRIHVGERPYECNECGKGFNRSTHLVQHQLIHTGVKPYECNECDKAFIHSSALIKHQRTHTGEKPYKCQECGKAFSHCSSLTKHQRVHTGEKPYECSECGKTFSQSTHLVQHQRIHTGEKPYECNECGKTFSRSSNFAKHQRIHIGKKPYKCSECGKAFIHSSALIQHQRTHTGEKPFRCNECGKSFKCSSSLIRHQRVHTEEQP

SEQ ID NO: 851877 - protein, 521 aa, Homo sapiens; identical to SEQ ID NO: 851876

SEQ ID NO: 851878 - protein, 521 aa, Homo sapiens; identical to SEQ ID NO: 851876

SEQ ID NO: 851879 - protein, 345 aa, Homo sapiens; identical to SEQ ID NO: 851872

SEQ ID NO: 851880 - protein, 232 aa, Homo sapiens
WPWPAEARTAPQAMTATLGSRGAAPGGSANSHGPSDPRVPLFRISLTSEDAGAGLAGALAASSRQPRKLGRCRQDPRRRTRRLLRLPSEAGAGGGASPSSRDSGDPSGGCDPCDAKGSSPMAARKQGRERDPPPSSRASKHNTRLPHACAADGRRPRGRGSAHRPKCGPSPAAPDPGGGQRDPPHLVTGTQPLGTLTECSPLTYPENTRTSSMSFQPYQTLRKLRKLSLVSR

SEQ ID NO: 851881 - protein, 232 aa, Homo sapiens; identical to SEQ ID NO: 851880

SEQ ID NO: 851882 - protein, 121 aa, Homo sapiens
MAGGQGPRSRDTAPQLRAEEASDSAARSEWAGARARLKDGCWRLAATAWEVTVRPAAPASSRGLLPPPYHEASKSSHAGLDLFSVAACHRFNLLGLHHLCFDGVCKTTAKEEIPRQNLWDE

SEQ ID NO: 851883 - protein, 232 aa, Homo sapiens; identical to SEQ ID NO: 851880

SEQ ID NO: 851884 - protein, 356 aa, Homo sapiens
MTLVLSMNRFCEPIVSEGAAEIAGYQTLWEADSYGGPSPPGPAQAPLQGDRGAGPPLAGSHYRGISNPITTSKITYFKRKYVEEEDFHPPLSSCSHKTISIFEERAHILYMSLEKLKFIDDPEVYLRRSVLINNLMKRIHGEIIMQNNWCFPACSFNGTSAQEWFMAQDCPYRKRPRMAKEECEKFHACCFYQECGGHYLNLPLSVNANVGSASTAASSPSASSSSSSSSSSPPLPLPSCSRQVDFDVGSASIYKSDGQIPANEIFVTNVRSLGVQEKAKLNDEKANDDTNRDGGPLSHEPVGNDLAFECKGQFYDYFETGYNERNNVNESWKKSLRKKEASPPSNKLCCSKGSKI

SEQ ID NO: 851885 - protein, 138 aa, Homo sapiens
MTLVLSMNRFCEPIVSEGAAEIAGYQTLWEADSYGGPSPPGPAQAPLQGDRGAGPPLAGSHYRGISNPITTSKITYFKRKYVEEEDFHPPLSSCSHKSRGQLVEDMTIKRHQLRNKYKTRIQGFLCDAARFLYPSNKW

SEQ ID NO: 851886 - protein, 121 aa, Homo sapiens
MTLVLSMNRFCEPIVSEGAAEIAGYQTLWEADSYGGPSPPGPAQAPLQGDRGAGPPLAAPLGDFLSVYQEQSRGQLVEDMTIKRHQLRNKYKTRIQGFLCDAARFLYPSNKCICDRLKNDD

SEQ ID NO: 851887 - protein, 147 aa, Homo sapiens
MTLVLSMNRFCEPIVSEGAAEIAGYQTLWEADSYGGPSPPGPAQAPLQGDRGAGPPLAGSHYRGISNPITTSKITYFKRKYVEEEDFHPPLSSCSHKSRGQLVEDMTIKRHQLRNKYKTRIQGFLCDAARFLYPSNKCICDRLKNDD

SEQ ID NO: 851888 - protein, 193 aa, Homo sapiens
LAQGRCLQVTAVQIQGSWKVTGVQPQKTGLYEYKVFGVLEDCSPTLLADIYMDSDYRKQWDQYVKELYEQECNGETVVYWEVKYPFPMSNRDYVYLRQRRDLDMEGRKIHVILARSTSMPQLGERSGVIRVKQYKQSLAIESDGKKGSKVFMYYFDNPGGQIPSWLINWAAKNGVPNFLKDMARACQNYLKKT

SEQ ID NO: 851889 - protein, 245 aa, Homo sapiens
QFPANDAGAAGAAGAARSPRPQAHTKGVRGLPSRRRSPDCGRMELAAGSFSEEQFWEACAELQQPALAGADWQLLVETSGISIYRLLDKKTGLYEYKVFGVLEDCSPTLLADIYMDSDYRKQWDQYVKELYEQECNGETVVYWEVKYPFPMSNRDYVYLRQRRDLDMEGRKIHVILARSTSMPQLGERSGVIRVKQYKQSLAIESDGKKGSKVFMYYFDNPGGQIPSWLINWAAKGGNCSGSLYH

SEQ ID NO: 851890 - protein, 256 aa, Homo sapiens
QFPANDAGAAGAAGAARSPRPQAHTKGVRGLPSRRRSPDCGRMELAAGSFSEEQFWEACAELQQPALAGADWQLLVETSGISIYRLLDKKTGLYEYKVFGVLEDCSPTLLADIYMDSDYRKQWDQYVKELYEQECNGETVVYWEVKYPFPMSNRDYVYLRQRRDLDMEGRKIHVILARSTSMPQLGERSGVIRVKQYKQSLAIESDGKKGSKVFMYYFDNPGGQIPSWLINWAAKNGVPNFLKDMARACQNYLKKT

SEQ ID NO: 851891 - protein, 305 aa, Homo sapiens
QFPANDAGAAGAAGAARSPRPQAHTKGVRGLPSRRRSPDCGRMELAAGSFSEEQFWEACAELQQPALAGADWQLLVETSGISIYRLLDKKTGLYEYKVFGVLEDCSPTLLADIYMDSDYRKQWDQYVKELYEQECNGETVVYWEVKYPFPMSNRDYVYLRQRRDLDMEGRKIHVILARSTSMPQLGERSGVIRVKQYKQSLAIESDGKKGSKVFMYYFDNPGGQIPSWLINWAAKAGLELLTSSNPLASASQSAGITGMSHHTRPIRAEPSGKLRIRETSSSFWQTQTFCNRLSGRKRKDIKIKT

SEQ ID NO: 851892 - protein, 261 aa, Homo sapiens
QFPANDAGAAGAAGAARSPRPQAHTKGVRGLPSRRRSPDCGRMELAAGSFSEEQFWEACAELQQPALAGADWQLLVETSGISIYRLLDKKTGLYEYKVFGVLEDCSPTLLADIYMDSDYRKQWDQYVKELYEQECNGETVVYWEVKYPFPMSNRDYVYLRQRRDLDMEGRKIHVILARSTSMPQLGERSGVIRVKQYKQSLAIESDGKKGSKVFMYYFDNPGGQIPSWLINWAAKNQSRTKREAQNQRDLIKFLANPNILQ

SEQ ID NO: 851893 - protein, 159 aa, Homo sapiens
VVVVHVNRDYVYLRQRRDLDMEGRKIHVILARSTSMPQLGERSGVIRVKQYKQSLAIESDGKKGSKVFMYYFDNPGGQIPSWLINWAAKAGLELLTSSNPLASASQSAGITGMSHHTRPIRAEPSGKLRIRETSSSFWQTQTFCNRLSGRKRKDIKIKT

SEQ ID NO: 851894 - protein, 256 aa, Homo sapiens; identical to SEQ ID NO: 851890

SEQ ID NO: 851895 - protein, 256 aa, Homo sapiens; identical to SEQ ID NO: 851890

SEQ ID NO: 851896 - protein, 261 aa, Homo sapiens; identical to SEQ ID NO: 851892

SEQ ID NO: 851897 - protein, 261 aa, Homo sapiens; identical to SEQ ID NO: 851892

SEQ ID NO: 851898 - protein, 107 aa, Homo sapiens
LSLPILRTIPSSEKTPLYFLLLFNPLCTPWEPKCKLPKMPESSPLPKWPSVFIAEPVKLVVAMFSGSPKHSPPSLPWKSRSGHQARQIFPLSLVLLVPRQSNILESI

SEQ ID NO: 851899 - protein, 370 aa, Homo sapiens
MVGKLKQNLLLACLVISSVTVFYLGQHAMECHHRIEERSQPVKLESTRTTVRTGLDLKANKTFAYHKDMPLIFIGGVPRSGTTLMRAMLDAHPDIRCGEETRVIPRILALKQMWSRSSKEKIRLDEAGVTDEVLDSAMQAFLLEIIVKHGEPAPYLCNKDPFALKSLTYLSRLFPNAKFLLMVRDGRASVHSMISRKVTIAGFDLNSYRDCLTKWNRAIETMYNQCMEVGYKKCMLVHYEQLVLHPERWMRTLLKFLQIPWNHSVLHHEEMIGKAGGVSLSKVERSTDQVIKPVNVGALSKWVGKIPPDVLQDMAVIAPMLAKLGYDPYANPPNYGKPDPKIIENTRRVYKGEFQLPDFLKEKPQTEQVE

SEQ ID NO: 851900 - protein, 360 aa, Homo sapiens
MVGKLKQNLLLACLVISSVTVFYLGQHAMECHHRIEERSQPVKLESTRTTVRTGLDLKANKTFAYHKDMPLIFIGGVPRSGTTLMRAMLDAHPDIRCGEETRVIPRILALKQMWSRSSKEKIRLDEAGVTDEVLDSAMQAFLLEIIVKHGEPAPYLCNKDPFALKSLTYLSRLFPNAKFLLMVRDGRASVHSMISRKVTIAGFDLNSYRDCLTKWNRAIETMYNQCMEVGYKKCMLVHYEQLVLHPERWMRTLLKFLQIPWNHSVLHHEEMIGKAGGVSLSKVERSTDQVIKPVNVGALSKWVGKIPPDVLQDMAVIAPMLAKLGYDPYANPPNYGKPDPKIIENTRRERLLPFQQKGNS

SEQ ID NO: 851901 - protein, 296 aa, Homo sapiens
MVGKLKQNLLLACLVISSVTVFYLGQHAMECHHRIEERSQPVKLESTRTTVRTGLDLKANKTFAYHKDMPLIFIGGVPRSGTTLMRAMLDAHPDIRCGEETRVIPRILALKQMWSRSSKEKIRLDEAGVTDEVLDSAMQAFLLEIIVKHGEPAPYLCNKDPFALKSLTYLSRLFPNAKFLLMVRDGRASVHSMISRKVTIAGFDLNSYRDCLTKWNRAIETMYNQCMEVGYKKCMLVHYEQLVLHPERWMRTLLKFLQIPWNHSVLHHEEMIGKAGGVSLSKLSKWSSRTRSLFHT

SEQ ID NO: 851902 - protein, 399 aa, Homo sapiens
MPSRRRGGSSLIPDVGYLSEVDCPWPEHFPKIILSQNLLLACLVISSVTVFYLGQHAMECHHRIEERSQPVKLESTRTTVRTGLDLKANKTFAYHKDMPLIFIGGVPRSGTTLMRAMLDAHPDIRCGEETRVIPRILALKQMWSRSSKEKIRLDEAGVTDEVLDSAMQAFLLEIIVKHGEPAPYLCNKDPFALKSLTYLSRLFPNAKFLLMVRDGRASVHSMISRKVTIAGFDLNSYRDCLTKWNRAIETMYNQCMEVGYKKCMLVHYEQLVLHPERWMRTLLKFLQIPWNHSVLHHEEMIGKAGGVSLSKVERSTDQVIKPVNVGALSKWVGKIPPDVLQDMAVIAPMLAKLGYDPYANPPNYGKPDPKIIENTRRVYKGEFQLPDFLKEKPQTEQVE

SEQ ID NO: 851903 - protein, 370 aa, Homo sapiens; identical to SEQ ID NO: 851899

SEQ ID NO: 851904 - protein, 214 aa, Homo sapiens
MVGKLKQNLLLACLVISSVTVFYLGQHAMECHHRIEERSQPVKLESTRTTVRTGLDLKANKTFAYHKDMPLIFIGGVPRSGTTLMRAMLDAHPDIRCGEETRVIPRILALKQMWSRSSKEKIRLDEAGVTDEVLDSAMQAFLLEIIVKHGEPAPYLCNKDPFALKSLTYLSRLFPNAVQRRGGSSLIPDVGYLSEVDCPWPEHFPKIILSKISV

SEQ ID NO: 851905 - protein, 370 aa, Homo sapiens; identical to SEQ ID NO: 851899

SEQ ID NO: 851906 - protein, 313 aa, Homo sapiens
MVGKLKQNLLLACLVISSVTVFYLGQHAMECHHRIEERSQPVKLESTRTTVRTGLDLKANKTFAYHKDMPLIFIGGVPRSGTTLMRAMLDAHPDIRCGEETRVIPRILALKQMWSRSSKEKIRLDEAGVTDEVLDSAMQAFLLEIIVKHGEPAPYLCNKDPFALKSLTYLSRLFPNAKFLLMVRDGRASVHSMISRKVTIAGFDLNSYRDCLTKWNRAIETMYNQCMEVGYKKCMLVHYEQLVLHPERWMRTLLKFLQIPWNHSVLHHEEMIGKAGGVSLSKSIRENSNYLTFLKKNHRLSKWSSRTRSLFHT

SEQ ID NO: 851907 - protein, 369 aa, Homo sapiens [sequence omitted]

SEQ ID NO: 851908 - protein, 83 aa, Homo sapiens
VSPPRTLNVGALSKWVGKIPPDVLQDMAVIAPMLAKLGYDPYANPPNYGKPDPKIIENTRRVYKGEFQLPDFLKEKPQTEQVE

SEQ ID NO: 851909 - protein, 71 aa, Homo sapiens
TAYNAADCINAADCIQRRCLHPTPLTASNAADCIQTPLTASNAADCIQRRLCICQFPPTERMEVSAQLWAS

SEQ ID NO: 851910 - protein, 929 aa, Homo sapiens
MTKKRKRQHDFQKVKLKVGKKKPKLQNATPTNFKTKTIHLPEQLKEDGTLPTNNRKLNIKDLLSQMHHYNAGVKQSALLGLKDLLSQYPFIIDAHLSNILSEVTAVFTDKDANVRLAAVQLLQFLAPKIRAEQISPFFPLVSAHLSSAMTHITEGIQEDSLKVLDILLEQYPALITGRSSILLKNFVELISHQQLSKGLINRDRSQSWILSVNPNRRLTSQQWRLKVLVRLSKFLQALADGSSRLRESEGLQEQKENPHATSNSIFINWKEHANDQQHIQVYENGGSQPNVSSQFRLRYLVGGLSGVDEGLSSTENLKGFIEIIIPLLIECWVEAVPPQLATPVGNGIEREPLQVMQQVLNIISLLWKLSKQQDETHKLESWLRKNYLIDFKHHFMSRFPYVLKEITKHKRKEPNKSIKHCTVLSNNIDHLLLNLTLSDIMVSLANASTLQKDCSWIEMIRKFVTETLEDGSRLNSKQLNRLLGVSWRLMQIQPNREDTETLIKAVYTLYQQRGLILPVRTLLLKFFSKIYQTEELRSCRFRYRSKVLSRWLAGLPLQLAHLGSRNPELSTQLIDIIHTAAARANKELLKSLQATALRIYDPQEGAVVVLPADSQQRLVQLVYFLPSLPADLLSRLSRCCIMGRLSSSLAAMLIGILHMRSSFSGWKYSAKDWLMSDVDYFSFLFSTLTGFSKEELTWLQSLRGVPHVIQTQLSPVLLYLTDLDQFLHHWDVTEAVFHSLLVIPARSQNFDILQSAISKHLVGLTVIPDSTAGCVFGVICKLLDHTCVVSETLLPFLASCCYSLLYFLLTIEKGEAEHLRKRDKLWGVCVSILALLPRVLRLMLQSLRVNRVGPEELPVVGQLLRLLLQHAPLRTHMLTNAILVQQIIKNITTLKSGSVQEQWLTDLHYCFNVYITGHPQGPSALATVY

SEQ ID NO: 851911 - protein, 929 aa, Homo sapiens; identical to SEQ ID NO: 851910

SEQ ID NO: 851912 - protein, 911 aa, Homo sapiens
MTKKRKRQHDFQKVKLKVGKKKPKLQNATPTNFKTKTIHLPEQLKEDGTLPTNNRKLNIKDLLSQMHHYNAGVKQSALLGLKDLLSQYPFIIDAHLSNILSEVTAVFTDKDANVRLAAVQLLQFLAPKIRAEQISPFFPLVSAHLSSAMTHITEGIQEDSLKVLDILLEQYPALITGRSSILLKNFVELISHQQLSKGLINRDRSQSWILSVNPNRRLTSQQWRLKVLVRLSKFLQALADGSSRLRESEGLQEQKENPHATSNSIFINWKEHANDQQHIQVYENGGSQPNVSSQFRLRYLVGGLSGVDEGLSSTENLKGFIEIIIPLLIECWVEAVPPQLATPVGNGIEREPLQVMQQVLNIISLLWKLSKQQDETHKLESWLRKNYLIDFKHHFMSRFPYVLKEITKHKRKEPNKSIKHCTVLSNNIDHLLLNLTLSDIMVSLANASTLQKDCSWIEMIRKFVTETLEDGSRLNSKQLNRLLGVSWRLMQIQPNREDTETLIKAVYTLYQQRGLILPVRTLLLKFFSKIYQTEELRSCRFRYRSKVLSRWLAGLPLQLAHLGSRNPELSTQLIDIIHTAAARANKELLVVLPADSQQRLVQLVYFLPSLPADLLSRLSRCCIMGRLSSSLAAMLIGILHMRSSFSGWKYSAKDWLMSDVDYFSFLFSTLTGFSKEELTWLQSLRGVPHVIQTQLSPVLLYLTDLDQFLHHWDVTEAVFHSLLVIPARSQNFDILQSAISKHLVGLTVIPDSTAGCVFGVICKLLDHTCVVSETLLPFLASCCYSLLYFLLTIEKGEAEHLRKRDKLWGVCVSILALLPRVLRLMLQSLRVNRVGPEELPVVGQLLRLLLQHAPLRTHMLTNAILVQQIIKNITTLKSGSVQEQWLTDLHYCFNVYITGHPQGPSALATVY

SEQ ID NO: 851913 - protein, 459 aa, Homo sapiens
MPTTSNTSRFMKMGVHSQMSVHSSGYEDTETLIKAVYTLYQQRGLILPVRTLLLKFFSKIYQTEELRSCRFRYRSKVLSRWLAGLPLQLAHLGSRNPELSTQLIDIIHTAAARANKELLKSLQATALRIYDPQEGAVVVLPADSQQRLVQLVYFLPSLPADLLSRLSRCCIMGRLSSSLAAMLIGILHMRSSFSGWKYSAKDWLMSDVDYFSFLFSTLTGFSKEELTWLQSLRGVPHVIQTQLSPVLLYLTDLDQFLHHWDVTEAVFHSLLVIPARSQNFDILQSAISKHLVGLTVIPDSTAGCVFGVICKLLDHTCVVSETLLPFLASCCYSLLYFLLTIEKGEAEHLRKRDKLWGVCVSILALLPRVLRLMLQSLRVNRVGPEELPVVGQLLRLLLQHAPLRTHMLTNAILVQQIIKNITTLKSGSVQEQWLTDLHYCFNVYITGHPQGPSALATVY

SEQ ID NO: 851914 - protein, 574 aa, Homo sapiens
MQQVLNIISLLWKLSKQQDETHKLESWLRKNYLIDFKHHFMSRFPYVLKEITKHKRKEPNKSIKHCTVLSNNIDHLLLNLTLSDIMVSLANASTLQKDCSWIEMIRKFVTETLEDGSRLNSKQLNRLLGVSWRLMQIQPNREDTETLIKAVYTLYQQRGLILPVRTLLLKFFSKIYQTEELRSCRFRYRSKVLSRWLAGLPLQLAHLGSRNPELSTQLIDIIHTAAARANKELLKSLQATALRIYDPQEGAVVVLPADSQQRLVQLVYFLPSLPADLLSRLSRCCIMGRLSSSLAAMLIGILHMRSSFSGWKYSAKDWLMSDVDYFSFLFSTLTGFSKEELTWLQSLRGVPHVIQTQLSPVLLYLTDLDQFLHHWDVTEAVFHSLLVIPARSQNFDILQSAISKHLVGLTVIPDSTAGCVFGVICKLLDHTCVVSETLLPFLASCCYSLLYFLLTIEKGEAEHLRKRDKLWGVCVSILALLPRVLRLMLQSLRVNRVGPEELPVVGQLLRLLLQHAPLRTHMLTNAILVQQIIKNITTLKSGSVQEQWLTDLHYCFNVYITGHPQGPSALATVY

SEQ ID NO: 851915 - protein, 793 aa, Homo sapiens
MTKKRKRQHDFQKVKLKVGKKKPKLQNATPTNFKTKTIHLPEQLKEDGTLPTNNRKLNIKDLLSQMHHYNAGVKQSALLGLKDLLSQYPFIIDAHLSNILSEVTAVFTDKDANVRLAAVQLLQFLAPKIRAEQISPFFPLVSAHLSSAMTHITEGIQEDSLKVLDILLEQYPALITGRSSILLKNFVELISHQQLSKGLINRDRSQSWILSVNPNRRLTSQQWRLKVLVRLSKFLQALADGSSRLRESEGLQEQKENPHATSNSIFINWKEHANDQQHIQVYENGGSQPNVSSQFRLRYLVGGLSGVDEGLSSTENLKGFIEIIIPLLIECWVEAVPPQLATPVGNGIEREPLQVMQQVLNIISLLWKLSKQQDETHKLESWLRKNYLIDFKHHFMSRFPYVLKEITKHKRKEPNKSIKHCTVLSNNIDHLLLNLTLSDIMVSLANASTLQKDCSWIEMIRKFVTETLEDGSRLNSKQLNRLLGVSWRLMQIQPNREDTETLIKAVYTLYQQRGLILPVRTLLLKFFSKIYQTEELRSCRFRYRSKVLSRWLAGLPLQLAHLGSRNPELSTQLIDIIHTAAARANKELLKSLQATALRIYDPQEGAVVVLPADSQQRLVQLVYFLPSLPADLLSRLSRCCIMGRLSSSLAAMLIGILHMRSSFSGWKYSAKDWLMSDVDYFSFLFSTLTGFSKEELTWLQSLRGVPHVIQTQLSPVLLYLTDLDQFLHHWDVTEAVFHSLLVIPARSQNFDILQSAISKHLGQAVGGLCLHPGSLASSPQVDAAEPAGEQSWA

SEQ ID NO: 851916 - protein, 927 aa, Homo sapiens
MTKKRKRQHDFQKVKLKVGKKKPKLQNATPTNFKTKTIHLPEQLKEDGTLPTNNRKLNIKDLLSQMHHYNAGVKQSALLGLKDLLSQYPFIIDAHLSNILSEVTAVFTDKDANVRLAAVQLLQFLAPKIRAEQISPFFPLVSAHLSSAMTHITEGIQEDSLKVLDILLEQYPALITGRSSILLKNFVELISHQQLSKGLINRDRSQSWILSVNPNRRLTSQQWRLKVLVRLSKFLQALADGSSRLRESEGLQEQKENPHATSNSIFINWKEHANDQQHIQVYENGGSQPNVSSQFRLRYLVGGLSGVDEGLSSTENLKGFIEIIIPLLIECWVEAVPPQLATPVGNGIEREPLQVMQQVLNIISLLWKLSKQQDETHKLESWLRKNYLIDFKHHFMSRFPYVLKEITKHKRKEPNKSIKHCTVLSNNIDHLLLNLTLSDIMVSLANASTLQKDCSWIEMIRKFVTETLEDGSRLNSKQLNRLLGVSWRLMQIQPNREDTETLIKAVYTLYQQRGLILPVRTLLLKFFSKIYQTEELRSCRFRYRSKVLSRWLAGLPLQLAHLGSRNPELSTQLIDIIHTAAARANKELLKSLQATALRIYDPQEGAVVVLPADSQQRLVQLVYFLPSLPADLLSRLSRCCIMGRLSSSLAAMLIGILHMRSSFSGWKYSAKDWLMSDVDYFSFLFSTLTGFSKEELTWLQSLRGVPHVIQTQLSPVLLYLTDLDQFLHHWDVTEAVFHSLLVIPARSQNFDILQSAISKHLVGLTVIPDSTAGCVFGVICKLLDHTCVVSETLLPFLASCCYSLLYFLLTIEKGEAEHLRKRDKLWGVCVSILALLPRVLRLMLQSLRVNRACCGPAASTAASACTPQDSYVDQCDLGAADHQEYHDIEEWKCSGTVAHRLTLLLQRVYHWASPRAQCTGYSVLKRP

SEQ ID NO: 851917 - protein, 844 aa, Homo sapiens
MTKKRKRQHDFQKVKLKVGKKKPKLQNATPTNFKTKTIHLPEQLKEDGTLPTNNRKLNIKDLLSQMHHYNAGVKQSALLGLKDLLSQYPFIIDAHLSNILSEVTAVFTDKDANVRLAAVQLLQFLAPKIRAEQISPFFPLVSAHLSSAMTHITEGIQEDSLKVLDILLEQYPALITGRSSILLKNFVELISHQQLSKGLINRDRSQSWILSVNPNRRLTSQQWRLKVLVRLSKFLQALADGSSRLRESEGLQEQKENPHATSNSIFINWKEHANDQQHIQVYENGGSQPNVSSQFRLRYLVGGLSGVDEGLSSTENLKGFIEIIIPLLIECWVEAVPPQLATPVGNGIEREPLQVMQQVLNIISLLWKLSKQQDETHKLESWLRKNYLIDFKHHFMSRFPYVLKEITKHKRKEPNKSIKHCTVLSNNIDHLLLNLTLSDIMVSLANASTLQKDCSWIEMIRKFVTETLEDGSRLNSKQLNRLLGVSWRLMQIQPNREDTETLIKAVYTLYQQRGLILPVRTLLLKFFSKIYQTEELRSCRFRYRSKVLSRWLAGLPLQLAHLGSRNPELSTQLIDIIHTAAARANKELLKSLQATALRIYDPQEGAVVVLPADSQQRLVQLVYFLPSLPADLLSRLSRCCIMGRLSSSLAAMLIGILHMRSSFSGWKYSAKDWLMSDVDYFSFLFSTLTGFSKEELTWLQSLRGVPHVIQTQLSPVLLYLTDLDQFLHHWDVTEAVFHSLLVIPARSQNFDILQSAISKHLVGLTVIPDSTAGCVFGVICKLLDHTCVVSETLLPFLASCCYSLLYFLLTIEKGEAEHLRKRTSCCWSVSPSSLSVLMVTGVCW

SEQ ID NO: 851918 - protein, 277 aa, Homo sapiens
RTRGSTHASSFSGWKYSAKDWLMSDVDYFSFLFSTLTGFSKEELTWLQSLRGVPHVIQTQLSPVLLYLTDLDQFLHHWDVTEAVFHSLLVIPARSQNFDILQSAISKHLVGLTVIPDSTAGCVFGVICKLLDHTCVVSETLLPFLASCCYSLLYFLLTIEKGEAEHLRKRDKLWGVCVSILALLPRVLRLMLQSLRVNRVGPEELPVVGQLLRLLLQHAPLRTHMLTNAILVQQIIKNITTLKSGSVQEQWLTDLHYCFNVYITGHPQGPSALATVY

SEQ ID NO: 851919 - protein, 429 aa, Homo sapiens
MTKKRKRQHDFQKVKLKVGKKKPKLQNATPTNFKTKTIHLPEQLKEDGTLPTNNRKLNIKDLLSQMHHYNAGVKQSALLGLKDLLSQYPFIIDAHLSNILSEVTAVFTDKDANVRLAAVQLLQFLAPKIRAEQISPFFPLVSAHLSSAMTHITEGIQEDSLKVLDILLEQYPALITGRSSILLKNFVELISHQQLSKGLINRDRSQSWILSVNPNRRLTSQQWRLKVLVRLSKFLQALADGSSRLRESEGLQEQKENPHATSNSIFINWKEHANDQQHIQVYENGGSQPNVSSQFRLRYLVGGLSGVDEGLSSTENLKGFIEIIIPLLIECWVEAVPPQLATPVGNGIEREPLQVMQQVLNIISLLWKLSKQQDETHKLESWLRKNYLIDFKHHFMSRFPYVLKEITKHKRKEPNKRYYDSFSLYNLEK

SEQ ID NO: 851920 - protein, 929 aa, Homo sapiens; identical to SEQ ID NO: 851910

SEQ ID NO: 851921 - protein, 903 aa, Homo sapiens [sequence omitted]

SEQ ID NO: 851922 - protein, 899 aa, Homo sapiens
MTKKRKRQHDFQKVKLKVGKKKPKLQNATPTNFKTKTIHLPEQLKEDGTLPTNNRKLNIKDLLSQMHHYNAGVKQSALLGLKDLLSQYPFIIDAHLSNILSEVTAVFTDKDANVRLAAVQLLQFLAPKIRAEQISPFFPLVSAHLSSAMTHITEGIQEDSLKVLDILLEQYPALITGRSSILLKNFVELISHQQLSKGLINRDRSQSWILSVNPNRRLTSQQWRLKVLVRLSKFLQALADGSSRLRESEGLQEQKENPHATSNSIFINWKEHANDQQHIQVYENGGSQPNVSSQFRLRYLVGGLSGVDEGLSSTENLKGFIEIIIPLLIECWVEAVPPQLATPVGNGIEREPLQVMQQVLNIISLLWKLSKQQDETHKLESWLRKNYLIDFKHHFMSRFPYVLKEITKHKRKEPNKSIKHCTVLSNNIDHLLLNLTLSDIMVSLANASTLQKDCSWIEMIRKFVTETLEDGSRLNSKQLNRLLGVSWRLMQIQPNREDTETLIKAVYTLYQQRGLILPVRTLLLKFFSKIYQTEELRSCRFRYRSKVLSRWLAGLPLQLAHLGSRNPELSTQLIDIIHTAAARANKELLKSLQATALRIYDPQEGAVVVLPADSQQRLVQLVYFLPSLPADLLSRLSRCCIMGRLSSSLAAMLIGILHMRSSFSGWKYSAKDWLMSDVDYFSFLFSTLTGFSKEELTWLQSLRGVPHVIQTQLSPVLLYLTDLDQFLHHWDVTEAVFHSLLVIPARSQNFDILQSAISKHLVGLTVIPDSTAGCVFGVICKLLDHTCVVSETLLPFLASCCYSLLYFLLTIEKGEAEHLRKRDKLWGVCVSILALLPRVLRLMLQSLRVNRACCGPAASTAASACTPQDSYVDQCDLGAADHQEYHGKKHGTGGFAVLA

SEQ ID NO: 851923 - protein, 903 aa, Homo sapiens [sequence omitted]

SEQ ID NO: 851924 - protein, 395 aa, Homo sapiens
ETFYGKERYRSKVLSRWLAGLPLQLAHLGSRNPELSTQLIDIIHTAAARANKELLKSLQATALRIYDPQEGAVVVLPADSQQRLVQLVYFLPSLPADLLSRLSRCCIMGRLSSSLAAMLIGILHMRSSFSGWKYSAKDWLMSDVDYFSFLFSTLTGFSKEELTWLQSLRGVPHVIQTQLSPVLLYLTDLDQFLHHWDVTEAVFHSLLVIPARSQNFDILQSAISKHLVGLTVIPDSTAGCVFGVICKLLDHTCVVSETLLPFLASCCYSLLYFLLTIEKGEAEHLRKRDKLWGVCVSILALLPRVLRLMLQSLRVNRVGPEELPVVGQLLRLLLQHAPLRTHMLTNAILVQQIIKNITTLKSGSVQEQWLTDLHYCFNVYITGHPQGPSALATVY

SEQ ID NO: 851925 - protein, 477 aa, Homo sapiens
MTKKRKRQHDFQKVKLKVGKKKPKLQNATPTNFKTKTIHLPEQLKEDGTLPTNNRKLNIKDLLSQMHHYNAGVKQSALLGLKDLLSQYPFIIDAHLSNILSEVTAVFTDKDANVRLAAVQLLQFLAPKIRAEQISPFFPLVSAHLSSAMTHITEGIQEDSLKVLDILLEQYPALITGRSSILLKNFVELISHQQLSKGLINRDRSQSWILSVNPNRRLTSQQWRLKVLVRLSKFLQALADGSSRLRESEGLQEQKENPHATSNSIFINWKEHANDQQHIQVYENGGSQPNVSSQFRLRYLVGGLSGVDEGLSSTENLKGFIEIIIPLLIECWVEAVPPQLATPVGNGIEREPLQVMQQVLNIISLLWKLSKQQDETHKLESWLRKNYLIDFKHHFMSRFPYVLKEITKHKRKEPNKSIKHCTVLSNNIDHLLLNLTLSDIMVSLANASTLQKDCSWIEMIRKFVTETPFENRVLGLK

SEQ ID NO: 851926 - protein, 1503 aa, Homo sapiens
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYKVEQKGIGGVGRGPPPFCHQRCLGPSSRAGDGRRVFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPGSYREPKHPLGGREACGMDTLPLNGNFNNSYSLRSGDFPPGDGGPEPPRGRNLADAAAFEKMIISELVHNNLRGSSSAAKGPPPPEPPVPPVPGGGGEEEAGGPGGADRAEIELLYKALEEPLLLPRAQSVLYQSDLDESESCTAEDGATSRPLSSPPGRDSLYASGANLRDSPSYPDSSPEGPSEALPPPPPAPPGPPEIYYTSRPPALVARNPLQGYYQVRRPSHEGYLAAPGLEGPGPDGDGQMQLVTSL

SEQ ID NO: 851927 - protein, 1460 aa, Homo sapiens
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYKVEQKGIGGVGRGPPPFCHQRCLGPSSRAGDGRRVFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPGSYREPKHPLGGREACGMDTLPLNGNFNNSYSLRSGDFPPPPEPPVPPVPGGGGEEEAGGPGGADRAEIELLYKALEEPLLLPRAQSVLYQSDLDESESCTAEDGATSRPLSSPPGRDSLYASGANLRDSPSYPDSSPEGPSEALPPPPPAPPGPPEIYYTSRPPALVARNPLQGYYQVRRPSHEGYLAAPGLEGPGPDGDGQMQLVTSL

SEQ ID NO: 851928 - protein, 1526 aa, Homo sapiens
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYKVEQKGIGGVGRGPPPFCHQRCLGPSSRAGDGRRVFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPNWSLDLHFELILAFSLLSSGCHLQGATGNPHPLGGREACGMDTLPLNGNFNNSYSLRSGDFPPGDGGPEPPRGRNLADAAAFEKMIISELVHNNLRGSSSAAKGPPPPEPPVPPVPGGGGEEEAGGPGGADRAEIELLYKALEEPLLLPRAQSVLYQSDLDESESCTAEDGATSRPLSSPPGRDSLYASGANLRDSPSYPDSSPEGPSEALPPPPPAPPGPPEIYYTSRPPALVARNPLQGYYQVRRPSHEGYLAAPGLEGPGPDGDGQMQLVTSL

SEQ ID NO: 851929 - protein, 1483 aa, Homo sapiens
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYKVEQKGIGGVGRGPPPFCHQRCLGPSSRAGDGRRVFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPNWSLDLHFELILAFSLLSSGCHLQGATGNPHPLGGREACGMDTLPLNGNFNNSYSLRSGDFPPPPEPPVPPVPGGGGEEEAGGPGGADRAEIELLYKALEEPLLLPRAQSVLYQSDLDESESCTAEDGATSRPLSSPPGRDSLYASGANLRDSPSYPDSSPEGPSEALPPPPPAPPGPPEIYYTSRPPALVARNPLQGYYQVRRPSHEGYLAAPGLEGPGPDGDGQMQLVTSL

SEQ ID NO: 851930 - protein, 1267 aa, Homo sapiens
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYKVEQKGIGGVGRGPPPFCHQRCLGPSSRAGDGRRVFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSLYASGANLRDSPSYPDSSPEGPSEALPPPPPAPPGPPEIYYTSRPPALVARNPLQGYYQVRRPSHEGYLAAPGLEGPGPDGDGQMQLVTSL

SEQ ID NO: 851931 - protein, 397 aa, Homo sapiens
MAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPGSYREPKHPLGGREACGMDTLPLNGNFNNSYSLRSGDFPPGDGGPEPPRGRNLADAAAFEKMIISELVHNNLRGSSSAAKGPPPPEPPVPPVPGGGGEEEAGGPGGADRAEIELLYKALEEPLLLPRAQSVLYQSDLDESESCTAEDGATSRPLSSPPGRDSLYASGANLRDSPSYPDSSPEGPSEALPPPPPAPPGPPEIYYTSRPPALVARNPLQGYYQVRRPSHEGYLAAPGLEGPGPDGDGQMQLVTSL

SEQ ID NO: 851932 - protein, 1481 aa, Homo sapiens
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYKVEQKGIGGVGRGPPPFCHQRCLGPSSRAGDGRRVFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPGSYREPKHPLGGREACGMDTLPLNGNFNNSYSLRSGDFPPGDGGPEPPRGRNLADAAAFEKMIISELVHNNLRGSSSAAKGPPPPEPPVPPVPGGGGEEEAGGPGGADRAEIELLYKALEEPLLLPRAQSVLYQSDLDESESCTAEDGATSRPLSSPPGRDSLYASGANLRDSPSYPDSSPEGPSEALPREREERGKGRRAKSKNRKKKKKKKKKRRRKKDTKEERLKQKR

SEQ ID NO: 851933 - protein, 150 aa, Homo sapiens
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYKVEQHLVPCADAGPSRMSE

SEQ ID NO: 851934 - protein, 146 aa, Homo sapiens
MFTIPRPLTQYLSLRPRLRWRCPGQATAPKAHSARSGLCRQCPGPPKGPRCRLQGRPGLRPSPPAGTLTPLSPHSQILGAGGHRAAVPAGPHLGFRPPLHQQGVGGHGLSLHHLQRLPGGLHLRLSLRLTEEGEVEAGSWVTASLG

SEQ ID NO: 851935 - protein, 1473 aa, Homo sapiens
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYKVERVFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPGSYREPKHPLGGREACGMDTLPLNGNFNNSYSLRSGDFPPGDGGPEPPRGRNLADAAAFEKMIISELVHNNLRGSSSAAKGPPPPEPPVPPVPGGGGEEEAGGPGGADRAEIELLYKALEEPLLLPRAQSVLYQSDLDESESCTAEDGATSRPLSSPPGRDSLYASGANLRDSPSYPDSSPEGPSEALPPPPPAPPGPPEIYYTSRPPALVARNPLQGYYQVRRPSHEGYLAAPGLEGPGPDGDGQMQLVTSL

SEQ ID NO: 851936 - protein, 1468 aa, Homo sapiens
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYKVEQKGIGGVGRGPPPFCHQRCLGPSSRAGDGRRVFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRDQEWGERGNIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPGSYREPKHPLGGREACGMDTLPLNGNFNNSYSLRSGDFPPGDGGPEPPRGRNLADAAAFEKMIISELVHNNLRGSSSAAKGPPPPEPPVPPVPGGGGEEEAGGPGGADRAEIELLYKALEEPLLLPRAQSVLYQSDLDESESCTAEDGATSRPLSSPPGRDSLYASGANLRDSPSYPDSSPEGPSEALPPPPPAPPGPPEIYYTSRPPALVARNPLQGYYQVRRPSHEGYLAAPGLEGPGPDGDGQMQLVTSL

SEQ ID NO: 851937 - protein, 1496 aa, Homo sapiens
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYKVEQKGIGGVGRGPPPFCHQRCLGPSSRAGDGRRVFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPHPLGGREACGMDTLPLNGNFNNSYSLRSGDFPPGDGGPEPPRGRNLADAAAFEKMIISELVHNNLRGSSSAAKGPPPPEPPVPPVPGGGGEEEAGGPGGADRAEIELLYKALEEPLLLPRAQSVLYQSDLDESESCTAEDGATSRPLSSPPGRDSLYASGANLRDSPSYPDSSPEGPSEALPPPPPAPPGPPEIYYTSRPPALVARNPLQGYYQVRRPSHEGYLAAPGLEGPGPDGDGQMQLVTSL

SEQ ID NO: 851938 - protein, 1226 aa, Homo sapiens
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYKVEQKGIGGVGRGPPPFCHQRCLGPSSRAGDGRRVFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQYTSRPPALVARNPLQGYYQVRRPSHEGYLAAPGLEGPGPDGDGQMQLVTSL

SEQ ID NO: 851939 - protein, 1503 aa, Homo sapiens; identical to SEQ ID NO: 851926

SEQ ID NO: 851940 - protein, 464 aa, Homo sapiens
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYKVEQKGIGGVGRGPPPFCHQRCLGPSSRAGDGRRVFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGEDDSLPGMEPACLCPLHPHPPLGPRVGSPIL

SEQ ID NO: 851941 - protein, 692 aa, Homo sapiens
MDQGYGGYGAWSAGPANTQGAYGTGVASWQGYENYNYYGAQNTSVTTGATYSYGPASWEAAKANDGGLAAGAPAMHMASYGPEPCTDNSDSLIAKINQRLDMMSKEGGRGGSGGGGEGIQDRESSFRFQPFESYDSRPCLPEHNPYRPSYSYDYEFDLGSDRNGSFGGQYSECRDPARERGSLDGFMRGRGQGRFQDRSNPGTFMRSDPFVPPAASSEPLSTPWNELNYVGGRGLGGPSPSRPPPSLFSQSMAPDYGVMGMQGAGGYDSTMPYGCGRSQPRMRDRDRPKRRGFDRFGPDGTGRKRKQFQLYEEPDTKLARVDSEGDFSENDDAAGDFRSGDEEFKGEDELCDSGRQRGEKEDEDEDVKKRREKQRRRDRTRDRAADRIQFACSVCKFRSFDDEEIQKHLQSKFHKETLRFISTKLPDKTVEFLQEYIVNRNKKIEKRRQELMEKETAKPKPDPFKGIGQEHFFKKIEAAHCLACDMLIPAQPQLLQRHLHSVDHNHNRRLAAEQFKKTSLHVAKSVLNNRHIVKMLEKYLKGEDPFTSETVDPEMEGDDNLGGEDKKETPEEVAADVLAEVITAAVRAVDGEGAPAPESSGEPAEDEGPTDTAEAGSDPQAEQLLEEQVPCGTAHEKGVPKARSEAAEAGNGAETMAAEAESAQTRVAPAPAAADAEVEQTDAESKDAVPTE

SEQ ID NO: 851942 - protein, 692 aa, Homo sapiens; identical to SEQ ID NO: 851941

SEQ ID NO: 851943 - protein, 178 aa, Homo sapiens
WGRAEVVTCAPGLPVVDGGGALNACVLWSPSKRGCWWAASKTWTRATEVCVGCWVRSGEGRLCAGDAAAAQTAAGRAFVPSVVAPAGPSGEAARARARRSLGFGAVAPGALRADWPPGPEEAGGTRGWGRRRGGLRGGVLDSVGRFCPSPSAESFRPPATPGFALPASSSEDATKWRR

SEQ ID NO: 851944 - protein, 437 aa, Homo sapiens
MDQGYGGYGAWSAGPANTQGAYGTGVASWQGYENYNYYGAQNTSVTTGATYSYGPASWEAAKANDGGLAAGAPAMHMASYGPEPCTDNSDSLIAKINQRLDMMSKEGGRGGSGGGGEGIQDRESSFRFQPFESYDSRPCLPEHNPYRPSYSYDYEFDLGSDRNGSFGGQYSECRDPARERGSLDGFMRGRGQGRFQDRSNPGTFMRSDPFVPPAASSEPLSTPWNELNYVGGRGLGGPSPSRPPPSLFSQSMAPDYGVMGMQGAGGYDSTMPYGCGRSQPRMRDRDRPKRRGFDRFGPDGTGRKRKQFQLYEEPDTKLARVDSEGDFSENDDAAGDFRSGDEEFKGEDELCDSGRQRGEKEDEDEDVKKRREKQRRRDRTRDRAADRIQFACSVCKFRSFDDEEIQKHLQSKFHKETLRFISTKLPDKTVEFLQDTL

SEQ ID NO: 851945 - protein, 605 aa, Homo sapiens
MKASSRFKAHQDALPRLPVPPLQQSLDHYLKALQPIVSEEEWAHTKQLVDEFQASGGVGERLQKGLERRARKTENWLSEWWLKTAYLQYRQPVVIYSSPGVMLPKQDFVDLQGQLRFAAKLIEGVLDFKVMIDNETLPVEYLGGKPLCMNQYYQILSSCRVPGPKQDTVSNFSKTKKPPTHITVVHNYQFFELDVYHSDGTPLTADQIFVQLEKIWNSSLQTNKEPVGILTSNHRNSWAKAYNTLIKDKVNRDSVRSIQKSIFTVCLDATMPRVSEDVYRSHVAGQMLHGGGSRLNSGNRWFDKTLQFIVAEDGSCGLVYEHAAAEGPPIVTLLDYVIEYTKKPELVRSPMVPLPMPKKLRFNITPEIKSDIEKAKQNLSIMIQDLDITVMVFHHFGKDFPKSEKLSPDAFIQMALQLAYYRIYGQACATYESASLRMFHLGRTDTIRSASMDSLTFVKAMDDSSVTEHQKVELLRKAVQAHRGYTDRAIRGEAFDRHLLGLKLQAIEDLVSMPDIFMDTSYAIAMHFHLSTSQVPAKTDCVMFFGPVVPDGYGVCYNPMEAHINFSLSAYNSCAETNAARLAHYLEKALLDMRALLQSHPRAKL

SEQ ID NO: 851946 - protein, 626 aa, Homo sapiens
MLAFAARTVVKPLGFLKPFSLMKASSRFKAHQDALPRLPVPPLQQSLDHYLKALQPIVSEEEWAHTKQLVDEFQASGGVGERLQKGLERRARKTENWLSEWWLKTAYLQYRQPVVIYSSPGVMLPKQDFVDLQGQLRFAAKLIEGVLDFKVMIDNETLPVEYLGGKPLCMNQYYQILSSCRVPGPKQDTVSNFSKTKKPPTHITVVHNYQFFELDVYHSDGTPLTADQIFVQLEKIWNSSLQTNKEPVGILTSNHRNSWAKAYNTLIKDKVNRDSVRSIQKSIFTVCLDATMPRVSEDVYRSHVAGQMLHGGGSRLNSGNRWFDKTLQFIVAEDGSCGLVYEHAAAEGPPIVTLLDYVIEYTKKPELVRSPMVPLPMPKKLRFNITPEIKSDIEKAKQNLSIMIQDLDITVMVFHHFGKDFPKSEKLSPDAFIQMALQLAYYRIYGQACATYESASLRMFHLGRTDTIRSASMDSLTFVKAMDDSSVTEHQKVELLRKAVQAHRGYTDRAIRGEAFDRHLLGLKLQAIEDLVSMPDIFMDTSYAIAMHFHLSTSQVPAKTDCVMFFGPVVPDGYGVCYNPMEAHINFSLSAYNSCAETNAARLAHYLEKALLDMRALLQSHPRAKL

SEQ ID NO: 851947 - protein, 605 aa, Homo sapiens; identical to SEQ ID NO: 851945

SEQ ID NO: 851948 - protein, 605 aa, Homo sapiens; identical to SEQ ID NO: 851945

SEQ ID NO: 851949 - protein, 475 aa, Homo sapiens [sequence omitted]

SEQ ID NO: 851950 - protein, 602 aa, Homo sapiens
MLAFAARTVVKPLGFLKPFSLMKASSRFKAHQDALPRLPVPPLQQSLDHYLKALQPIVSEEEWAHTKQLVDEFQASGGVGERLQKGLERRARKTENWLSEWWLKTAYLQYRQPVVIYSSPGVMLPKQDFVDLQGQLRFAAKLIEGVLDFKVMIDNETLPVEYLGGKPLCMNQYYQILSSCRVPGPKQDTVSNFSKTKKPPTHITVVHNYQFFELDVYHSDGTPLTADQIFVQLEKIWNSSLQTNKEPVGILTSNHRNSWAKAYNTLIKDKVNRDSVRSIQKSIFTVCLDATMPRVSEDVYRSHVAGQMLHGGGSRLNSGNRWFDKTLQFIVAEDGSCGLVYEHAAAEGPPIVTLLDYVIEYTKKPELVRSPMVPLPMPKKLRFNITPEIKSDIEKAKQNLSIMIQDLDITVMVFHHFGKDFPKSEKLSPDAFIQMALQLAYYRIYGQACATYESASLRMFHLGRTDTIRSASMDSLTFVKAMDDSSVTEHQKVELLRKAVQAHRGYTDRAIRGEAFDRHLLGLKLQAIEDLVPAKTDCVMFFGPVVPDGYGVCYNPMEAHINFSLSAYNSCAETNAARLAHYLEKALLDMRALLQSHPRAKL

SEQ ID NO: 851951 - protein, 299 aa, Homo sapiens
MLAFAARTVVKPLGFLKPFSLMKASSRFKAHQDALPRLPVPPLQQSLDHYLKALQPIVSEEEWAHTKQLVDEFQASGGVGERLQKGLERRARKTENWLSEWWLKTAYLQYRQPVVIYSSPGVMLPKQDFVDLQGQLRFAAKLIEGVLDFKVMIDNETLPVEYLGGKPLCMNQYYQILSSCRVPGPKQDTVSNFSKTKKPPTHITVVHNYQFFELDVYHSDGTPLTADQIFVQLEKIWNSSLQTNKEPVGILTSNHRNSWAKAYNTLIKGASWGPCWGCTPRPLPLLGTSLNSTCRVPEV

SEQ ID NO: 851952 - protein, 626 aa, Homo sapiens; identical to SEQ ID NO: 851946

SEQ ID NO: 851953 - protein, 544 aa, Homo sapiens
MLAFAARTVVKPLGFLKPFSLMKASSRFKAHQDALPRLPVPPLQQSLDHYLKALQPIVSEEEWAHTKQLVDEFQASGGVGERLQKGLERRARKTENWLSEWWLKTAYLQYRQPVVIYSSPGVMLPKQDFVDLQGQLRFAAKLIEGVLDFKVMIDNETLPVEYLGGKPLCMNQYYQILSSCRVPGPKQDTVSNFSKTKKPPTHITVVHNYQFFELDVYHSDGTPLTADQIFVQLEKIWNSSLQTNKEPVGILTSNHRNSWAKAYNTLIKDKVNRDSVRSIQKKPELVRSPMVPLPMPKKLRFNITPEIKSDIEKAKQNLSIMIQDLDITVMVFHHFGKDFPKSEKLSPDAFIQMALQLAYYRIYGQACATYESASLRMFHLGRTDTIRSASMDSLTFVKAMDDSSVTEHQKVELLRKAVQAHRGYTDRAIRGEAFDRHLLGLKLQAIEDLVSMPDIFMDTSYAIAMHFHLSTSQVPAKTDCVMFFGPVVPDGYGVCYNPMEAHINFSLSAYNSCAETNAARLAHYLEKALLDMRALLQSHPRAKL

SEQ ID NO: 851954 - protein, 633 aa, Homo sapiens
GSRAGEGMNRMFCYLQVKPLGFLKPFSLMKASSRFKAHQDALPRLPVPPLQQSLDHYLKALQPIVSEEEWAHTKQLVDEFQASGGVGERLQKGLERRARKTENWLSEWWLKTAYLQYRQPVVIYSSPGVMLPKQDFVDLQGQLRFAAKLIEGVLDFKVMIDNETLPVEYLGGKPLCMNQYYQILSSCRVPGPKQDTVSNFSKTKKPPTHITVVHNYQFFELDVYHSDGTPLTADQIFVQLEKIWNSSLQTNKEPVGILTSNHRNSWAKAYNTLIKDKVNRDSVRSIQKSIFTVCLDATMPRVSEDVYRSHVAGQMLHGGGSRLNSGNRWFDKTLQFIVAEDGSCGLVYEHAAAEGPPIVTLLDYVIEYTKKPELVRSPMVPLPMPKKLRFNITPEIKSDIEKAKQNLSIMIQDLDITVMVFHHFGKDFPKSEKLSPDAFIQMALQLAYYRIYGQACATYESASLRMFHLGRTDTIRSASMDSLTFVKAMDDSSVTEHQKVELLRKAVQAHRGYTDRAIRGEAFDRHLLGLKLQAIEDLVSMPDIFMDTSYAIAMHFHLSTSQVPAKTDCVMFFGPVVPDGYGVCYNPMEAHINFSLSAYNSCAETNAARLAHYLEKALLDMRALLQSHPRAKL

SEQ ID NO: 851955 - protein, 626 aa, Homo sapiens; identical to SEQ ID NO: 851946

SEQ ID NO: 851956 - protein, 477 aa, Homo sapiens
MSCSGALTPKSDHLCGFPGCHTSSHVTPGLRFPVSKVGQVLGPASRSAVGLQGPVEFEALNPHPALGECPGGPARWGVSSSQRVQMGQKSPGQEAAEGLVHLSHTMRPHFASPRPMPPADKVNRDSVRSIQKSIFTVCLDATMPRVSEDVYRSHVAGQMLHGGGSRLNSGNRWFDKTLQFIVAEDGSCGLVYEHAAAEGPPIVTLLDYVIEYTKKPELVRSPMVPLPMPKKLRFNITPEIKSDIEKAKQNLSIMIQDLDITVMVFHHFGKDFPKSEKLSPDAFIQMALQLAYYRIYGQACATYESASLRMFHLGRTDTIRSASMDSLTFVKAMDDSSVTEHQKVELLRKAVQAHRGYTDRAIRGEAFDRHLLGLKLQAIEDLVSMPDIFMDTSYAIAMHFHLSTSQVPAKTDCVMFFGPVVPDGYGVCYNPMEAHINFSLSAYNSCAETNAARLAHYLEKALLDMRALLQSHPRAKL

SEQ ID NO: 851957 - protein, 408 aa, Homo sapiens
MLAFAARTVVKPLGFLKPFSLMKASSRFKAHQDALPRLPVPPLQQSLDHYLKALQPIVSEEEWAHTKQLVDEFQASGGVGERLQKGLERRARKTENWLSEWWLKTAYLQYRQPVVIYSSPGVMLPKQDFVDLQGQLRFAAKLIEGVLDFKVMIDNETLPVEYLGGKPLCMNQYYQILSSCRVPGPKQDTVSNFSKTKKPPTHITVVHNYQFFELDVYHSDGTPLTADQIFVQLEKIWNSSLQTNKEPVGILTSNHRNSWAKAYNTLIKDKVNRDSVRSIQKSIFTVCLDATMPRVSEDVYRSHVAGQMLHGGGSRLNSGNRWFDKTLQFIVAEDGSCGLVYEHAAAEGPPIVTLLDYVIEYTKKPELVRSPMVPLPMPKKLRFNITPRCLPCVALLHVRSSVCSHFPL

SEQ ID NO: 851958 - protein, 140 aa, Homo sapiens
MKASSRFKAHQDALPRLPVPPLQQSLDHYLKALQPIVSEEEWAHTKQLVDEFQASGGVGERLQKGLERRARKTENWVSEGILTVTCCWLHMHSSPVPTALARPFVCCPEFREHILCVWHLAGCWVIKKDTVTSSLELTFK

SEQ ID NO: 851959 - protein, 262 aa, Homo sapiens
MGAGNFLTALEVPVAALAGAASDRRASCERVSPPPPLPHFRLPSLFLVPGSQGPSVPSRPEPGAPLLGCWLQWGAPSPGPLCLLFRLCSCTCFAPLPAGADMDPNPRAALERQQLRLRERQKFFEDILQPETEFVFPLSHLHLESQRPPIGSISSMEVNVDTLEQVELIDLGDPDAADVFLPCEDPPPTPQSSGVDNHLEELSLPVPTSDRTTSRTSSSSSSDSSTNLHSPNPSDDGADTPLAQSDEEEERGDGGAEPGACS

SEQ ID NO: 851960 - protein, 174 aa, Homo sapiens
MCSVRYPAGLVPGSGGSGRGCTHYACATSAPPLRCFPRKRFFPFFPTQPLLPPWSLELCLSRPAAPLLHGPVCQRCFGSPPVRPGHAQTLRSSSLSLGMAGQFRSYVWDPLLILSQIVLMQTVYYGSLGLWLALVDGLVRSSPSLDQMFDAEILGFSTPPGRLSMMSFILNALT

SEQ ID NO: 851961 - protein, 125 aa, Homo sapiens
MDPNPRAALERQQLRLRERHHLHLESQRPPIGSISSMEVNVDTLEQVELIDLGDPDAADVFLPCEDPPPTPQSSGVDNHLEELSLPVPTSDRTTSRTDDGADTPLAQSDEEEERGDGGAEPGACS

SEQ ID NO: 851962 - protein, 161 aa, Homo sapiens [sequence omitted]

SEQ ID NO: 851963 - protein, 254 aa, Homo sapiens
MCSVRYPAGLVPGSGGSGRGCTHYACATSAPPLRCFPRKRFFPFFPTQPLLPPWSLELCLSRPAAPLLHGPVCQRCFGSPPVRPGHAQTLRSSSLSLGMAGQFRSYVWDPLLILSQIVLMQTVYYGSLGLWLALVDGLVRSSPSLDQMFDAEILGFSTPPGRLSMMSFILNALTCALGLLYFIRRGKQCLDFTVTVHFFHLLGCWFYSSRFPSALTWWLVQAVCIALMAVIGEYLCMRTELKEIPLNSAPKSNV

SEQ ID NO: 851964 - protein, 263 aa, Homo sapiens [sequence omitted]

SEQ ID NO: 851965 - protein, 156 aa, Homo sapiens
MAGQFRSYVWDPLLILSQIVLMQTVYYGSLGLWLALVDGLVRSSPSLDQMFDAEILGFSTPPGRLSMMSFILNALTCALGLLYFIRRGKQCLDFTVTVHFFHLLGCWFYSSRFPSALTWWLVQAVCIALMAVIGEYLCMRTELKEIPLNSAPKSNV

SEQ ID NO: 851966 - protein, 161 aa, Homo sapiens [sequence omitted]

SEQ ID NO: 851967 - protein, 161 aa, Homo sapiens [sequence omitted]

SEQ ID NO: 851968 - protein, 161 aa, Homo sapiens [sequence omitted]

SEQ ID NO: 851969 - protein, 263 aa, Homo sapiens [sequence omitted]

SEQ ID NO: 851970 - protein, 107 aa, Homo sapiens [sequence omitted]

SEQ ID NO: 851971 - protein, 214 aa, Homo sapiens
MESWALAVFPEYRVSLLWCLELASPLWSLGQAPPLHETWFVGHTWFQGRGKRSPRAEVSRPEPGAPLLGCWLQWGAPSPGPLCLLFRLCSCTCFAPLPAGADMDPNPRAALERQQLRLRERQKFFEDILQPETEFVFPLSHLHLESQRPPIGSISSMEVNVDTLEQVELIDLGDPDAADVFLPCEDPPPTPQSSGMPLCFGDFSASQPEPDVRL

SEQ ID NO: 851972 - protein, 112 aa, Homo sapiens
MDPNPRAALERQQLRLRERQKFFEDILQPETEFVFPLSHLHLESQRPPIGSISSMEVNVDTLEQVELIDLGDPDAADVFLPCEDPPPTPQSSGMPLCFGDFSASQPEPDVRL

SEQ ID NO: 851973 - protein, 81 aa, Homo sapiens
PVCGLTSFSLWAGVDNHLEELSLPVPTSDRTTSRTSSSSSSDSSTNLHSPNPSDDGADTPLAQSDEEEERGDGGAEPGACS

SEQ ID NO: 851974 - protein, 178 aa, Homo sapiens
RAGRRCHGDRPLAEARLVSLQGMAGQFRSYVWDPLLILSQIVLMQTVYYGSLGLWLALVDGLVRSSPSLDQMFDAEILGFSTPPGRLSMMSFILNALTCALGLLYFIRRGKQCLDFTVTVHFFHLLGCWFYSSRFPSALTWWLVQAVCIALMAVIGEYLCMRTELKEIPLNSAPKSNV

SEQ ID NO: 851975 - protein, 235 aa, Homo sapiens
MCSVRYPAGLVPGSGGSGRGCTHYACATSAPPLRCFPRKRFFPFFPTQPLLPPWSLELCLSRPAAPLLHGPVCQRCFGSPPVRPGHAQTLRSSSLSLIVLMQTVYYGSLGLWLALVDGLVRSSPSLDQMFDAEILGFSTPPGRLSMMSFILNALTCALGLLYFIRRGKQCLDFTVTVHFFHLLGCWFYSSRFPSALTWWLVQAVCIALMAVIGEYLCMRTELKEIPLNSAPKSNV

SEQ ID NO: 851976 - protein, 126 aa, Homo sapiens
WGNRSYENRCPLLAAASVVEFDAEILGFSTPPGRLSMMSFILNALTCALGLLYFIRRGKQCLDFTVTVHFFHLLGCWFYSSRFPSALTWWLVQAVCIALMAVIGEYLCMRTELKEIPLNSAPKSNV

SEQ ID NO: 851977 - protein, 156 aa, Homo sapiens; identical to SEQ ID NO: 851965

SEQ ID NO: 851978 - protein, 248 aa, Homo sapiens
MCSVRYPAGLVPGSGGSGRGCTHYACATSAPPLRCFPRKRFFPFFPTQPLLPPWSLELCLSRPAAPLLHGPVCQRCFGSPPVRPGHAQTLRSSSLSLGMAGQFRSYVWDPLLILSQIVLMQTVYYGSLGLWLALVDGLVRSSPSLDQMFDAEILGFSTPPGRLSMMSFILNALTCALGLLYFIRRGKQCLDFTVTVHFFHLLGCWFYSSRFPSALTWWLVQAVCIALMAVIGEYLCMRTELKEIGICC

SEQ ID NO: 851979 - protein, 151 aa, Homo sapiens
MCSVRYPAGLVPGSGGSGRGCTHYACATSAPPLRCFPRKRFFPFFPTQPLLPPWSLELCLSRPAAPLLHGPVCQRCFGSPPVRPGHAQTLRSSSLSLGMAGQFRSYVWDPLLILSQIVLMQTVYYGSLGLLPALNIAGHRTQRRIPALLKV

SEQ ID NO: 851980 - protein, 161 aa, Homo sapiens [sequence omitted]

SEQ ID NO: 851981 - protein, 167 aa, Homo sapiens
MRLGADMDPNPRAALERQQLRLRERQKFFEDILQPETEFVFPLSHLHLESQRPPIGSISSMEVNVDTLEQVELIDLGDPDAADVFLPCEDPPPTPQSSGVDNHLEELSLPVPTSDRTTSRTSSSSSSDSSTNLHSPNPSDDGADTPLAQSDEEEERGDGGAEPGACS

SEQ ID NO: 851982 - protein, 263 aa, Homo sapiens [sequence omitted]

SEQ ID NO: 851983 - protein, 156 aa, Homo sapiens; identical to SEQ ID NO: 851965

SEQ ID NO: 851984 - protein, 225 aa, Homo sapiens
DTARYEAWCESAEGFFPTQPLLPPWSLELCLSRPAAPLLHGPVCQRCFGSPPVRPGHAQTLRSSSLSLGMAGQFRSYVWDPLLILSQIVLMQTVYYGSLGLWLALVDGLVRSSPSLDQMFDAEILGFSTPPGRLSMMSFILNALTCALGLLYFIRRGKQCLDFTVTVHFFHLLGCWFYSSRFPSALTWWLVQAVCIALMAVIGEYLCMRTELKEIPLNSAPKSNV

SEQ ID NO: 851985 - protein, 161 aa, Homo sapiens [sequence omitted]

SEQ ID NO: 851986 - protein, 284 aa, Homo sapiens
RAGRRCHGDRPLAEARLVSLQGMAGQFRSYVWDPLLILSQIVLMQTVYYGSLGLWLALVDGLVRSSPSLDQMFDAEILGFSTPPGRLSMMSFILNALTWHFSLLLPHEEGRVCFPFHHELGADMDPNPRAALERQQLRLRERQKFFEDILQPETEFVFPLSHLHLESQRPPIGSISSMEVNVDTLEQVELIDLGDPDAADVFLPCEDPPPTPQSSGVDNHLEELSLPVPTSDRTTSRTSSSSSSDSSTNLHSPNPSDDGADTPLAQSDEEEERGDGGAEPGACS

SEQ ID NO: 851987 - protein, 263 aa, Homo sapiens [sequence omitted]

SEQ ID NO: 851988 - protein, 245 aa, Homo sapiens
MESWALAVFPEYRVSLLWCLELASPLWSLGQAPPLHETWFVGHTWFQGRGKRSPRAEVSRPEPGAPLLGCWLQWGAPSPGPLCLLFRLCSCTCFAPLPAGADMDPNPRAALERQQLRLRERHHLHLESQRPPIGSISSMEVNVDTLEQVELIDLGDPDAADVFLPCEDPPPTPQSSGVDNHLEELSLPVPTSDRTTSRTSSSSSSDSSTNLHSPNPSDDGADTPLAQSDEEEERGDGGAEPGACS

SEQ ID NO: 851989 - protein, 156 aa, Homo sapiens; identical to SEQ ID NO: 851965

SEQ ID NO: 851990 - protein, 112 aa, Homo sapiens; identical to SEQ ID NO: 851972

SEQ ID NO: 851991 - protein, 156 aa, Homo sapiens; identical to SEQ ID NO: 851965

SEQ ID NO: 851992 - protein, 156 aa, Homo sapiens
MCSVRYPAGLVPGSGGSGRGCTHYACATSAPPLRCFPRKRFFPFFPTQPLLPPWSLELCLSRPAAPLLHGPVCQRCFGSPPVRPGHAQTLRSSSLSLGMAGQFRSYVWDPLLILSQIVLMQTVYYGSLGLWLALVDGLVRSSPSLDQMFDAEAGSP

SEQ ID NO: 851993 - protein, 253 aa, Homo sapiens
MESWALAVFPEYRVSLLWCLELASPLWSLGQAPPLHETWFVGHTWFQGRGKRSPRAEVSRPEPGAPLLGCWLQWGAPSPGPLCLLFRLCSCTCFAPLPAGADMDPNPRAALERQQLRLRERQKFFEDILQPETEFVFPLSHLHLESQRPPIGSISSMEVNVDTLEQVELIDLGDPDAADVFLPCEDPPPTPQSSGVDNHLEELSLPVPTSDRTTSRTSSSSSSDSSTNLHSPNPSDDGADTPLAQSDEEEATD

SEQ ID NO: 851994 - protein, 250 aa, Homo sapiens
MESWALAVFPEYRVSLLWCLELASPLWSLGQAPPLHETWFVGHTWFQGRGKRSPRAEVSRPEPGAPLLGCWLQWGAPSPGPLCLLFRLCSCTCFAPLPAGADMDPNPRAALERQQLRLRERQKFFEDILQPETEFVFPLSHLHLESQRPPIGSISSMEVNVDTLEQVELIDLGDPDAADVFLPCEDPPPTPQSSGVDNHLEELSLPLQTDHAGYSPHETTGPARACREKTRLFTCSRHQRWEGWWDCVPF

SEQ ID NO: 851995 - protein, 248 aa, Homo sapiens; identical to SEQ ID NO: 851978

SEQ ID NO: 851996 - protein, 431 aa, Homo sapiens
MPPILQRLQQATKMMSRRKILLLVLGCSTVSLLIHQGAQLSWYPKLFPLSCPPLRNSPPRPKHMTVAFLKTHKTAGTTVQNILFRFAERHNLTVALPHPSCEHQFCYPRNFSAHFVHPATRPPHVLASHLRFDRAELERLMPPSTVYVTILREPAAMFESLFSYYNQYCPAFRRVPNASLEAFLRAPEAYYRAGEHFAMFAHNTLAYDLGGDNERSPRDDAAYLAGLIRQVEEVFSLVMIAEYFDESLVLLRRLLAWDLDDVLYAKLNARAASSRLAAIPAALARAARTWNALDAGLYDHFNATFWRHVARAGRACVEREARELREARQRLLRRCFGDEPLLRPAAQIRTKQLQPWQPSRKVDIMGYDLPGGGAGPATEACLKLAMPEVQYSNYLLRKQKRRGGARARPEPVLDNPPPRPIRVLPRGPQGP

SEQ ID NO: 851997 - protein, 431 aa, Homo sapiens; identical to SEQ ID NO: 851996

SEQ ID NO: 851998 - protein, 343 aa, Homo sapiens
VLTAAMEALAMGSRALRLWLVAPGGGIKWRFIATSPASQLSPTELTEMRNDLFNKEKARQLSLTPRTEKIEVKHVGKTDPGTVFVMNKNISTPYSCAMHLSEWYCRKSILALVDGQPWDMYKPLTKSCEIKFLTFKDCDPGEVNKAYWRSCAMMMGCVIERAFKDEYMVNLVRAPEVPVISGAFCYDVVLDSKLDEWMPTKENLRSFTKDAHALIYKDLPFETLEVEAKVALEIFQHSKYKVDFIEEKASQNPERIVKLHRIGDFIDVSEGPLIPRTSICFQYEVSAVHNLQPTQPSLIRRFQGVSLPVHLRAHFTIWDKLLERSRKMVTEDQSKATEECTST

SEQ ID NO: 851999 - protein, 169 aa, Homo sapiens
GGLASVYQNYVNLVRAPEVPVISGAFCYDVVLDSKLDEWMPTKENLRSFTKDAHALIYKDLPFETLEVEAKVALEIFQHSKYKVDFIEEKASQNPERIVKLHRIGDFIDVSEGPLIPRTSICFQYEVSAVHNLQPTQPSLIRRFQGVSLPVHLRAHFTIWDNTFARGIL

SEQ ID NO: 852000 - protein, 358 aa, Homo sapiens
VLTAAMEALAMGSRALRLWLVAPGGGIKWRFIATSPASQLSPTELTEMRNDLFNKEKARQLSLTPRTEKIEVKHVGKTDPGTVFVMNKNISTPYSCAMHLSEWYCRKSILALVDGQPWDMYKPLTKSCEIKFLTFKDCDPGEVNKAYWRSCAMMMGCVIERAFKDEYMVNLVRAPEVPVISGAFCYDVVLDSKLDEWMPTKENLRSFTKDAHALIYKDLPFETLEVEAKVALEIFQHSKYKVDFIEEKASQNPERIVKLHRIGDFIDVSEGPLIPRTSICFQYEVSAVHNLQPTQPSLIRRFQGVSLPVHLRAHFTIWDKLLERSRKMTPFPILLLFTTQSFFTTSPESYLLHGTVSE

SEQ ID NO: 852001 - protein, 316 aa, Homo sapiens
VLTAAMEALAMGSRALRLWLVAPGGGIKWRFIATSPASQLSPTELTEMRNDLFNKEKARQLSLTPRTEKIEVKHVGKTDPGTVFVMNKNISTPYSCAMHLSEWYCRKSILALVDGQPWDMYKPLTKSCEIKFLTFKDCDPGEVNKAYWRSCAMMMGCVIERAFKDEYMVNLVRAPEVPVISGAFCYDVVLDSKLDEWMPTKENLRSFTKDAHALIYKDLPFETLEVEAKVALEIFQHSKYKVDFIEEKASQNPERIVKLHRIGDFIDVSEGPLIPRTSICFQYEVSAVHNLQPTQPSLIRRFQGVSLPVHLRVSKA

SEQ ID NO: 852002 - protein, 134 aa, Homo sapiens
CEALVFAVRPSRIPISPDTDLLSRRVSPAWYKVDFIEEKASQNPERIVKLHRIGDFIDVSEGPLIPRTSICFQYEVSAVHNLQPTQPSLIRRFQGVSLPVHLRAHFTIWDKLLERSRKMVTEDQSKATEECTST

SEQ ID NO: 852003 - protein, 343 aa, Homo sapiens; identical to SEQ ID NO: 851998

SEQ ID NO: 852004 - protein, 252 aa, Homo sapiens
VLTAAMEALAMGSRALRLWLVAPGGGIKWRFIATSPASQLSPTELTEMRNDLFNKEKARQLSLTPRTEKIEVKHVGKTDPGTVFVMNKNISTPYSCAMHLSEWYCRKSILALVDGQPWDMYKPLTKSCEIKFLTFKDCDPGEVNKAYWRSCAMMMGCVIERAFKDEYMVNLVRAPEVPVLDSKLDEWMPTKENLRSFTKDAHALIYKDLPFETLEVEAKVALEIFQHSKYTVDSSERRKASPEPERIVKVHE

SEQ ID NO: 852005 - protein, 144 aa, Homo sapiens
MTGSSPAASNMAASIQRSRVPASGFRTVGQATSGSAMAGFPGLERKFRRGRPRGKSVSAGERGESPKRPRKSQGVEAPAVEPCGVCVVTPCLCPCSPMLPPCLELSGKRPRLFFYMDLETQGTAGLTPSPPSGSLTSSTSVPMP

SEQ ID NO: 852006 - protein, 226 aa, Homo sapiens
MSVPLLTDAATVSGAERETAAVIFLHGLGDTGHSWADALSTIRLPHVKYICPHAPRIPVTLNMKMVMPSWFDLMGLSPDAPEDEAGIKKAAENIKALIEHEMKNGIPANRIVLGGFSQGGALSLYTALTCPHPLAGIVALSCWLPLHRAFPQAANGSAKDLAILQCHGELDPMVPVRFGALTAEKLRSVVTPARVQFKTYPGVMHSSCPQEMAAVKEFLEKLLPPV

SEQ ID NO: 852007 - protein, 226 aa, Homo sapiens; identical to SEQ ID NO: 852006

SEQ ID NO: 852008 - protein, 226 aa, Homo sapiens; identical to SEQ ID NO: 852006

SEQ ID NO: 852009 - protein, 226 aa, Homo sapiens; identical to SEQ ID NO: 852006

SEQ ID NO: 852010 - protein, 285 aa, Homo sapiens
RFAVSGSSSRTEPGCCVGLMAWWPHWARECVLCLVLLLTAAPMYAGPRRGAVWCMCGNTMSVPLLTDAATVSGAERETAAVIFLHGLGDTGHSWADALSTIRLPHVKYICPHAPRIPVTLNMKMVMPSWFDLMGLSPDAPEDEAGIKKAAENIKALIEHEMKNGIPANRIVLGGFSQGGALSLYTALTCPHPLAGIVALSCWLPLHRAFPQAANGSAKDLAILQCHGELDPMVPVRFGALTAEKLRSVVTPARVQFKTYPGVMHSSCPQEMAAVKEFLEKLLPPV

SEQ ID NO: 852011 - protein, 219 aa, Homo sapiens
LGPDWGDRKASPRSVIFLHGLGDTGHSWADALSTIRLPHVKYICPHAPRIPVTLNMKMVMPSWFDLMGLSPDAPEDEAGIKKAAENIKALIEHEMKNGIPANRIVLGGFSQGGALSLYTALTCPHPLAGIVALSCWLPLHRAFPQAANGSAKDLAILQCHGELDPMVPVRFGALTAEKLRSVVTPARVQFKTYPGVMHSSCPQEMAAVKEFLEKLLPPV

SEQ ID NO: 852012 - protein, 244 aa, Homo sapiens
VVKPGLVCSQWQQQQAPAVEPCGVCVVTPCLCPCSPMLPPCLELSGKRPRHSWADALSTIRLPHVKYICPHAPRIPVTLNMKMVMPSWFDLMGLSPDAPEDEAGIKKAAENIKALIEHEMKNGIPANRIVLGGFSQGGALSLYTALTCPHPLAGIVALSCWLPLHRAFPQAANGSAKDLAILQCHGELDPMVPVRFGALTAEKLRSVVTPARVQFKTYPGVMHSSCPQEMAAVKEFLEKLLPPV

SEQ ID NO: 852013 - protein, 125 aa, Homo sapiens
MKNGIPANRIVLGGFSQGGALSLYTALTCPHPLAGIVALSCWLPLHRAFPQAANGSAKDLAILQCHGELDPMVPVRFGALTAEKLRSVVTPARVQFKTYPGVMHSSCPQEMAAVKEFLEKLLPPV

SEQ ID NO: 852014 - protein, 177 aa, Homo sapiens
MSVPLLTDAATVSGAERETAAVIFLHGLGDTGHSWADALSTIRLPHVKYICPHAPRIPVTLNMKMVMPSWFDLMGLSPDAPEDEAGIKKAAENIKALIEHEMKNGIPANRIVLGGFSQGGALSLYTALTCPHPLAGIVALSCWLPLHRAFPQGPVQDIPGCHAQLLSSGDGSCEGIS

SEQ ID NO: 852015 - protein, 172 aa, Homo sapiens
MSVPLLTDAATVSGAERETAAVIFLHGLGDTGHSWADALSTIRLPHVKYICPHAPRIPVTLNMKMVMPSWFDLMGLSPDAPEDEAGIKKAAENIKALIEHEMKNGIPANRIVLGGFSQGGALSLYTALTCPHLSHPHFVPTLEQGGSGGGVVSRLLSPCGFWVFFLLCPGFR

SEQ ID NO: 852016 - protein, 226 aa, Homo sapiens; identical to SEQ ID NO: 852006

SEQ ID NO: 852017 - protein, 226 aa, Homo sapiens; identical to SEQ ID NO: 852006

SEQ ID NO: 852018 - protein, 226 aa, Homo sapiens; identical to SEQ ID NO: 852006

SEQ ID NO: 852019 - protein, 226 aa, Homo sapiens; identical to SEQ ID NO: 852006

SEQ ID NO: 852020 - protein, 259 aa, Homo sapiens
IHSGLAFNLPFLPQSPMSRGPRRGAVWCMCGNTMSVPLLTDAATVSGAERETAAVIFLHGLGDTGHSWADALSTIRLPHVKYICPHAPRIPVTLNMKMVMPSWFDLMGLSPDAPEDEAGIKKAAENIKALIEHEMKNGIPANRIVLGGFSQGGALSLYTALTCPHPLAGIVALSCWLPLHRAFPQAANGSAKDLAILQCHGELDPMVPVRFGALTAEKLRSVVTPARVQFKTYPGVMHSSCPQEMAAVKEFLEKLLPPV

SEQ ID NO: 852021 - protein, 305 aa, Homo sapiens
MTGSSPAASNMAASIQRSRVPASGFRTVGQATSGSAMAGFPGLERKFRRGRPRGKSVSAGERGESPKRPRKSQGVEAPAVEPCGVCVVTPCLCPCSPMLPPCLELSGKRPRHSWADALSTIRLPHVKYICPHAPRIPVTLNMKMVMPSWFDLMGLSPDAPEDEAGIKKAAENIKALIEHEMKNGIPANRIVLGGFSQGGALSLYTALTCPHPLAGIVALSCWLPLHRAFPQAANGSAKDLAILQCHGELDPMVPVRFGALTAEKLRSVVTPARVQFKTYPGVMHSSCPQEMAAVKEFLEKLLPPV

SEQ ID NO: 852022 - protein, 164 aa, Homo sapiens
MKMVMPSWFDLMGLSPDAPEDEAGIKKAAENIKALIEHEMKNGIPANRIVLGGFSQGGALSLYTALTCPHPLAGIVALSCWLPLHRAFPQAANGSAKDLAILQCHGELDPMVPVRFGALTAEKLRSVVTPARVQFKTYPGVMHSSCPQEMAAVKEFLEKLLPPV

SEQ ID NO: 852023 - protein, 179 aa, Homo sapiens
MTGSSPAASNMAASIQRSRVPASGFRTVGQATSGSAMAGFPGLERKFRRGRPRGKSVSAGERGESPKRPRKSQGVEAPAVEPCGVCVVTPCLCPCSPMLPPCLELSGKRPRLFFYMDLETQGTAGLTPSPPSGSLTSSTSVPMRRGPVPLHGPHLPPPSGWHRGVELLAASAPGLPPGS

SEQ ID NO: 852024 - protein, 169 aa, Homo sapiens
MSVPLLTDAATVSGAERETAAYFFTWTLRSTTKGPTCPWGPGERPPSIPTPPPSKKPPPGGAPPNFFPPKKKNPGALFLKPKLPGYPPKLGRLASLCTLNMKMVMPSWFDLMGLSPDAPGGSEAGAIPKRANKGGAQKGPHKGKTRKKTPKFPKTGGPPFLANSGNANL

SEQ ID NO: 852025 - protein, 301 aa, Homo sapiens
MLEPQENGVIDLPDYEHVEDETFPPFPPPASPERQDGEGTEPDEESGNGAPVPVPPKRTVKRNIPKLDAQRLISERGLPALRHVFDKAKFKGKGHEAEDLKMLIRHMEHWAHRLFPKLQFEDFIDRVEYLGSKKEVQTCLKRIRLDLPILHEDFVSNNDEVAENNEHDVTSTELDPFLTNLSESEMFASELSRSLTEEQQQRIERNKQLALERRQAKLLSNSQTLGNDMLMNTPRAHTVEEVNTDEDQKEESNGLNEDILDNPCNDAIANTLNEEETLLDQSFKNVQQQLDATSRNITEAR

SEQ ID NO: 852026 - protein, 223 aa, Homo sapiens
TAWGRGPSRTPWRPLSPRGKQVDPAEKKSVSLCGELSRPGAARPPPLRSFAVCTARVKTILINQTVDIPENVNITLKGHTVIVNGPRGTLRRDFNHINVELSLLGKKKKEALVDKWWGNRKELATVRTICSHVQNMIKGVTLGFRYKMRSVYAYFPIIVVIPENGSVVEIRNFLGEKYIRRVRMRPGVACSVSQAQKDELIFEGNDIELVSNSAALIQQATTV

SEQ ID NO: 852027 - protein, 68 aa, Homo sapiens
TAWGRGPSRTPWRPLSPRGKQVDPAEKKSVSLCGELSRPGAARPPPLRVKDIRCTEQRKRVQNKGNIY

SEQ ID NO: 852028 - protein, 351 aa, Homo sapiens
LPGGGVRRGRRGALCRPEASRWTQLRRSLCRCVVSSPGQVPRGLHLCEEKMLEPQENGVIDLPDYEHVEDETFPPFPPPASPERQDGEGTEPDEESGNGAPVPVPPKRTVKRNIPKLDAQRLISERGLPALRHVFDKAKFKGKGHEAEDLKMLIRHMEHWAHRLFPKLQFEDFIDRVEYLGSKKEVQTCLKRIRLDLPILHEDFVSNNDEVAENNEHDVTSTELDPFLTNLSESEMFASELSRSLTEEQQQRIERNKQLALERRQAKLLSNSQTLGNDMLMNTPRAHTVEEVNTDEDQKEESNGLNEDILDNPCNDAIANTLNEEETLLDQSFKNVQQQLDATSRNITEAR

SEQ ID NO: 852029 - protein, 337 aa, Homo sapiens
TAWGRGPSRTPWRPLSPRGKQVDPAEKKSVSLCEEKMLEPQENGVIDLPDYEHVEDETFPPFPPPASPERQDGEGTEPDEESGNGAPVPVPPKRTVKRNIPKLDAQRLISERGLPALRHVFDKAKFKGKGHEAEDLKMLIRHMEHWAHRLFPKLQFEDFIDRVEYLGSKKEVQTCLKRIRLDLPILHEDFVSNNDEVAENNEHDVTSTELDPFLTNLSESEMFASELSRSLTEEQQQRIERNKQLALERRQAKLLSNSQTLGNDMLMNTPRAHTVEEVNTDEDQKEESNGLNEDILDNPCNDAIANTLNEEETLLDQSFKNVQQQLDATSRNITEAR

SEQ ID NO: 852030 - protein, 302 aa, Homo sapiens
MTTVSQDREASCTCSIHLGIPSTYYAKITNDGVADSETLKRSHWTQSGNGAPVPVPPKRTVKRNIPKLDAQRLISERGLPALRHVFDKAKFKGKGHEAEDLKMLIRHMEHWAHRLFPKLQFEDFIDRVEYLGSKKEVQTCLKRIRLDLPILHEDFVSNNDEVAENNEHDVTSTELDPFLTNLSESEMFASELSRSLTEEQQQRIERNKQLALERRQAKLLSNSQTLGNDMLMNTPRAHTVEEVNTDEDQKEESNGLNEDILDNPCNDAIANTLNEEETLLDQSFKNVQQQLDATSRNITEAR

SEQ ID NO: 852031 - protein, 285 aa, Homo sapiens
MLEPQENGVIDLPDYEHVEDETFPPFPPPASPERQDGEGTEPDEESGNGAPVPVPPKRTVKRNIPKLDAQRLISERGLPALRHVFDKAKFKGKGHEAEDLKMLIRHMEHWAHRLFPKLQFEDFIDRVEYLGSKKEVQTCLKRIRLDLPILHEDFVSNNDEVAENNEHDVTSTELDPFLTNLSESEMFASELSRSLTEEQQQRIERNKQLALERRQAKLLSNSQTLGNDCLIPRAHGAVFWWLKGAMVRDLDLVCLPLWRTARLRRVSIRIKMPGVLGELKGGVGG

SEQ ID NO: 852032 - protein, 209 aa, Homo sapiens
TAWGRGPSRTPWRPLSPRGKQVDPAEKKSVSLCGSFAVCTARVKTILINQTVDIPENVNITLKGHTVIVNGPRGTLRRDFNHINVELSLLGKKKKEALVDKWWGNRKELATVRTICSHVQNMIKGVTLGFRYKMRSVYAYFPIIVVIPENGSVVEIRNFLGEKYIRRVRMRPGVACSVSQAQKDELIFEGNDIELVSNSAALIQQATTV

SEQ ID NO: 852033 - protein, 301 aa, Homo sapiens; identical to SEQ ID NO: 852025

SEQ ID NO: 852034 - protein, 301 aa, Homo sapiens; identical to SEQ ID NO: 852025

SEQ ID NO: 852035 - protein, 161 aa, Homo sapiens
MIESSRYPLVLDSFNSNNDEVAENNEHDVTSTELDPFLTNLSESEMFASELSRSLTEEQQQRIERNKQLALERRQAKLLSNSQTLGNDMLMNTPRAHTVEEVNTDEDQKEESNGLNEDILDNPCNDAIANTLNEEETLLDQSFKNVQQQLDATSRNITEAR

SEQ ID NO: 852036 - protein, 146 aa, Homo sapiens
QRQNKNDLSHLSAWRYRPFTGLLPDPCLQPHLKDCPRQRQTRIRSTQVDQVFRLAKRQGRPLLPAPPPHRLASPDISHAPHPGQFALTFQCLIAQATSTGVADAGRAHRVRAPWCLSPAPAKGHKAWQEPRRTRERRRRGQAAGGR

SEQ ID NO: 852037 - protein, 1447 aa, Homo sapiens [sequence omitted]

SEQ ID NO: 852038 - protein, 1049 aa, Homo sapiens
MENSLRCVWVPKLAFVLFGASLLSAHLQVTGFQIKAFTALRFLSEPSDAVTMRGGNVLLDCSAESDRGVPVIKWKKDGIHLALGMDERKQQLSNGSLLIQNILHSRHHKPDEGLYQCEASLGDSGSIISRTAKVAVAGPLRFLSQTESVTAFMGDTVLLKCEVIGEPMPTIHWQKNQQDLTPIPGDSRVVVLPSGALQISRLQPGDIGIYRCSARNPASSRTGNEAEVRILSDPGLHRQLYFLQRPSNVVAIEGKDAVLECCVSGYPPPSFTWLRGEEVIQLRSKKYSLLGGSNLLISNVTDDDSGMYTCVVTYKNENISASAELTVLVPPWFLNHPSNLYAYESMDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRLSWRPPAEAKGNIQTFTVFFSREGDNRERALNTTQPGSLQLTVGNLKPEAMYTFRVVAYNEWGPGESSQPIKVATQPELQVPGPVENLQAVSTSPTSILITWEPPAYANGPVQGYRLFCTEVSTGKEQNIEVDGLSYKLEGLKKFTEYSLRFLAYNRYGPGVSTDDITVVTLSDVPSAPPQNVSLEVVNSRSIKVSWLPPPSGTQNGFITGYKIRHRKTTRRGEMETLEPNNLWYLFTGLEKGSQYSFQVSAMTVNGTGPPSNWYTAETPENDLDESQVPDQPSSLHVRPQTNCIIMSWTPPLNPNIVVRGYIIGYGVGSPYAETVRVDSKQRYYSIERLESSSHYVISLKAFNNAGEGVPLYESATTRSITDLSTPMLPPVGVQAVALTHDAVRVSWADNSVPKNQKTSEVRLYTVRWRTSFSASAKYKSEDTTSLSYTATGLKPNTMYEFSVMVTKNRRSSTWSMTAHATTYEAAPTSAPKDLTVITREGKPRAVIVSWQPPLEANGKITAYILFYTLDKNIPIDDWIMETISGDRLTHQIMDLNLDTMYYFRIQARNSKGVGPLSDPILFRTLKVEHPDKMANDQDTGVTINLVNEVLLG

SEQ ID NO: 852039 - protein, 1414 aa, Homo sapiens
SSPPPPPIPFAVPFRPLGFQIKAFTALRFLSEPSDAVTMRGGNVLLDCSAESDRGVPVIKWKKDGIHLALGMDERKQQLSNGSLLIQNILHSRHHKPDEGLYQCEASLGDSGSIISRTAKVAVAGPLRFLSQTESVTAFMGDTVLLKCEVIGEPMPTIHWQKNQQDLTPIPGDSRVVVLPSGALQISRLQPGDIGIYRCSARNPASSRTGNEAEVRILSDPGLHRQLYFLQRPSNVVAIEGKDAVLECCVSGYPPPSFTWLRGEEVIQLRSKKYSLLGGSNLLISNVTDDDSGMYTCVVTYKNENISASAELTVLVPPWFLNHPSNLYAYESMDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRLSWRPPAEAKGNIQTFTVFFSREGDNRERALNTTQPGSLQLTVGNLKPEAMYTFRVVAYNEWGPGESSQPIKVATQPELQVPGPVENLQAVSTSPTSILITWEPPAYANGPVQGYRLFCTEVSTGKEQNIEVDGLSYKLEGLKKFTEYSLRFLAYNRYGPGVSTDDITVVTLSDVPSAPPQNVSLEVVNSRSIKVSWLPPPSGTQNGFITGYKIRHRKTTRRGEMETLEPNNLWYLFTGLEKGSQYSFQVSAMTVNGTGPPSNWYTAETPENDLDESQVPDQPSSLHVRPQTNCIIMSWTPPLNPNIVVRGYIIGYGVGSPYAETVRVDSKQRYYSIERLESSSHYVISLKAFNNAGEGVPLYESATTRSITDLSTPMLPPVGVQAVALTHDAVRVSWADNSVPKNQKTSEVRLYTVRWRTSFSASAKYKSEDTTSLSYTATGLKPNTMYEFSVMVTKNRRSSTWSMTAHATTYEAAPTSAPKDLTVITREGKPRAVIVSWQPPLEANGKITAYILFYTLDKNIPIDDWIMETISGDRLTHQIMDLNLDTMYYFRIQARNSKGVGPLSDPILFRTLKVEHPDKMANDQGRHGDGGYWPVDTNLIDRSTLNEPPIGQMHPPHGSVTPQKNSNLLVIIVVTVGVITVLVVVIVAVICTRRSSAQQRKKRATHSAGKRKGSQKDLRPPDLWIHHEEMEMKNIEKPSGTDPAGRDSPIQSCQDLTPVSHSQSETQLGSKSTSHSGQDTEEAGSSMSTLERSLAARRAPRAKLMIPMDAQSNNPAVVSAIPVPTLESAQYPGILPSPTCGYPHPQFTLRPVPFPTLSVDRGFGAGRSQSVSEGPTTQQPPMLPPSQPEHSSSEEAPSRTIPTACVRPTHPLRSFANPLLPPPMSAIEPKVPYTPLLSQPGPTLPKTHVKTASLGLAGKARSPLLPVSVPTAPEVSEESHKPTEDSANVYEQDDLSEQMASLEGLMKQLNAITGSAF

SEQ ID NO: 852040 - protein, 328 aa, Homo sapiens
SSPPPPPIPFAVPFRPLGFQIKAFTALRFLSEPSDAVTMRGGNVLLDCSAESDRGVPVIKWKKDGIHLALGMDERKQQLSNGSLLIQNILHSRHHKPDEGLYQCEASLGDSGSIISRTAKVAVAGPLRFLSQTESVTAFMGDTVLLKCEVIGEPMPTIHWQKNQQDLTPIPGDSRVVVLPSGALQISRLQPGDIGIYRCSARNPASSRTGNEAEVRILSDPGLHRQLYFLQRPSNVVAIEGKDAVLECCVSGYPPPSFTWLRGEEVIQLRSKKYSLLGGSNLLISNVTDDDSGMYTCVVTYKNENISASAELTVLVIIDKVLVDTFWV

SEQ ID NO: 852041 - protein, 128 aa, Homo sapiens
SSPPPPPIPFAVPFRPLGFQIKAFTALRFLSEPSDAVTMRGGNVLLDCSAESDRGVPVIKWKKDGIHLALGMDERKQQLSNGSLLIQNILHSRHHKPDEGLYQCEASLGDSGSIISRTAKVAVAEEQI

SEQ ID NO: 852042 - protein, 1427 aa, Homo sapiens
MENSLRCVWVPKLAFVLFGASLLSAHLQVTGFQIKAFTALRFLSEPSDAVTMRGGNVLLDCSAESDRGVPVIKWKKDGIHLALGMDERKQQLSNGSLLIQNILHSRHHKPDEGLYQCEASLGDSGSIISRTAKVAVAGPLRFLSQTESVTAFMGDTVLLKCEVIGEPMPTIHWQKNQQDLTPIPGDSRVVVLPSGALQISRLQPGDIGIYRCSARNPASSRTGNEAEVRILSDPGLHRQLYFLQRPSNVVAIEGKDAVLECCVSGYPPPSFTWLRGEEVIQLRSKKYSLLGGSNLLISNVTDDDSGMYTCVVTYKNENISASAELTVLVPPWFLNHPSNLYAYESMDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRLSWRPPAEAKGNIQTFTVFFSREGDNRERALNTTQPGSLQLTVGNLKPEAMYTFRVVAYNEWGPGESSQPIKVATQPELQVPGPVENLQAVSTSPTSILITWEPPAYANGPVQGYRLFCTEVSTGKEQNIEVDGLSYKLEGLKKFTEYSLRFLAYNRYGPGVSTDDITVVTLSDVPSAPPQNVSLEVVNSRSIKVSWLPPPSGTQNGFITGYKIRHRKTTRRGEMETLEPNNLWYLFTGLEKGSQYSFQVSAMTVNGTGPPSNWYTAETPENDLDESQVPDQPSSLHVRPQTNCIIMSWTPPLNPNIVVRGYIIGYGVGSPYAETVRVDSKQRYYSIERLESSSHYVISLKAFNNAGEGVPLYESATTRSITDLSTPMLPPVGVQAVALTHDAVRVSWADNSVPKNQKTSEVRLYTVRWRTSFSASAKYKSEDTTSLSYTATGLKPNTMYEFSVMVTKNRRSSTWSMTAHATTYEAAPTSAPKDLTVITREGKPRAVIVSWQPPLEANGKITAYILFYTLDKNIPIDDWIMETISGDRLTHQIMDLNLDTMYYFRIQARNSKGVGPLSDPILFRTLKVEHPDKMANDQGRHGDGGYWPVDTNLIDRSTLNEPPIGQMHPPHGSVTPQKNSNLLVIIVVTVGVITVLVVVIVAVICTRRSSAQQRKKRATHSAGKRKGSQKDLRPPDLWIHHEEMEMKNIEKPSGTDPAGRDSPIQSCQDLTPVSHSQSETQLGSKSTSHSGQDTEEAGSSMSTLERSLAARRAPRAKLMIPMDAQSNNPAVVSAIPVPTLESAQYPGILPSPTCGYPHPQFTLRPVPFPTLSVDRGFGAGRSQSVSEGPTTQQPPMLPPSQPEHSSSEEAPSRTIPTACVRPTHPLRSFANPLLPPPMSAIEPKVPYTPLLSQPGPTLPKTHVKTASLGLAGKARSPLLPVSVPTAPEVSEESHKPTEDSANVYEQDDLSEQMASLEGLMKQLNAITGSAF

SEQ ID NO: 852043 - protein, 1412 aa, Homo sapiens
MENSLRCVWVPKLAFVLFGASLLSAHLQVTGFQIKAFTALRFLSEPSDAVTMRGGNVLLDCSAESDRGVPVIKWKKDGIHLALGMDERKQQLSNGSLLIQNILHSRHHKPDEGLYQCEASLGDSGSIISRTAKVAVAGPLRFLSQTESVTAFMGDTVLLKCEVIGEPMPTIHWQKNQQDLTPIPGDSRVVVLPSGALQISRLQPGDIGIYRCSARNPASSRTGNEAEVRILSDPGLHRQLYFLQRPSNVVAIEGKDAVLECCVSGYPPPSFTWLRGEEVIQLRSKKYSLLGGSNLLISNVTDDDSGMYTCVVTYKNENISASAELTVLVPPWFLNHPSNLYAYESMDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRLSWRPPAEAKGNIQTFTVFFSREGDNRERALNTTQPGSLQLTVGNLKPEAMYTFRVVAYNEWGPGESSQPIKVATQPELQVPGPVENLQAVSTSPTSILITWEPPAYANGPVQGYRLFCTEVSTGKEQNIEVDGLSYKLEGLKKFTEYSLRFLAYNRYGPGVSTDDITVVTLSDVPSAPPQNVSLEVVNSRSIKVSWLPPPSGTQNGFITGYKIRHRKTTRRGEMETLEPNNLWYLFTGLEKGSQYSFQVSAMTVNGTGPPSNWYTAETPENDLDESQVPDQPSSLHVRPQTNCIIMSWTPPLNPNIVVRGYIIGYGVGSPYAETVRVDSKQRYYSIERLESSSHYVISLKAFNNAGEGVPLYESATTRSITDLSTPMLPPVGVQAVALTHDAVRVSWADNSVPKNQKTSEVRLYTVRWRTSFSASAKYKSEDTTSLSYTATGLKPNTMYEFSVMVTKNRRSSTWSMTAHATTYEAAPTSAPKDLTVITREGKPRAVIVSWQPPLEANGKITAYILFYTLDKNIPIDDWIMETISGDRLTHQIMDLNLDTMYYFRIQARNSKGVGPLSDPILFRTLKVEHPDKMANDQGRHGDGGYWPVDTNLIDRSTLNEPPIGQMHPPHGSVTPQKNSNLLVIIVVTVGVITVLVVVIVAVICTRRSSAQQRKKRATHSAGKRKGSQKDLRPPDLWIHHEEMEMKNIEKPSGTDPAGRDSPIQSCQDLTPVSHSQSETQLGSKSTSHSGQDTEEAGSSMSTLERSLAARRAPRAKLMIPMDAQSNNPAVVSAIPVPTLESAQYPGILPSPTCGYPHPQFTLRPVPFPTLSVDRGFGAGRSQSVSEGPTTQQPPMLPPSQPEHSSSEEAPSRTIPTACVRPTHPLRSFANPLLPPPMSAIEPKVPYTPLLSQPGPTLPKTHVKTASLGLAGKARSPLLPVSVPTAPEVSEESHKPTEDSANVRASLKFMLHQGTD

SEQ ID NO: 852044 - protein, 128 aa, Homo sapiens
SSPPPPPIPFAVPFRPLGFQIKAFTALRFLSEPSDAVTMRGGNVLLDCSAESDRGVPVIKWKKDGIHLALGMDERKQQLSNGSLLIQNILHSRHHKPDEGLYQCEASLGDSGSIISRTAKVAVAEREM

SEQ ID NO: 852045 - protein, 191 aa, Homo sapiens
PSFANGPACPSLASVLASPVSLASPVSQPRQCPSLASEPKSENYTYIWWLNGQSLPVSPRVKRPIENRILILPNVTRNETGPYQCEIRDRYGGIRSDPVTLNVLYGPDLPSIYPSFTYYRSGENLYLSCFAESNPPAEYFWTINGKFQQSGQKLSIPQITTKHRGLYTCSVRNSATGKARTLARLDTGEAR

SEQ ID NO: 852046 - protein, 335 aa, Homo sapiens
MGPLSAPPCTQHITWKGVLLTASLLNFWNLPITAQVTIEALPPKVSEGKDVLLLVHNLPQNLAGYIWYKGQLMDLYHYITSYVVDGQINIYGPAYTGRETVYSNASLLIQNVTREDAGSYTLHIIKRGDRTRGVTGYFTFNLYLKLPKPYITINNSKPRENKDVLAFTCEPKSENYTYIWWLNGQSLPVSPRVKQPIENRILILPSVTRNETGPYECEIRDRDGGMHSDPVTLNVLYGPDLPSIYPSFTYYRSGENLYLSCFAESNPPAEYFWTINGKFQQSGQKLSIPQITTKHRGLYTCSVRNSATGKESSKSMTVEVSAPSGIGRLPLLNPI

SEQ ID NO: 852047 - protein, 335 aa, Homo sapiens; identical to SEQ ID NO: 852046

SEQ ID NO: 852048 - protein, 335 aa, Homo sapiens; identical to SEQ ID NO: 852046

SEQ ID NO: 852049 - protein, 176 aa, Homo sapiens
ENKDVLAFTCEPKSENYTYIWWLNGQSLPVSPGVKRPIENRILILPSVTRNETGPYQCEIRDRYGGLRSNPVILNVLYGPDLPSIYPSFTYYRSGENLYLSCFAESNPPAEYFWTINGKFQQSGQKLSIPQITTKHRGLYTCSVRNSATGKESSKSMTVEVSAPSGIGRLPLLNPI

SEQ ID NO: 852050 - protein, 335 aa, Homo sapiens; identical to SEQ ID NO: 852046

SEQ ID NO: 852051 - protein, 336 aa, Homo sapiens
MGPLSAPPCTQHITWKGVLLTASLLNFWNLPITAQVTIEALPPKVSEGKDVLLLVHNLPQNLAGYIWYKGQLMDLYHYITSYVVDGQINIYGPAYTGRETVYSNASLLIQNVTREDAGSYTLHIIKRGDRTRGVTGYFTFNLYLKLPKPYITINNSKPRENKDVLAFTCEPKSENYTYIWWLNGQSLPVSPRVKQPIENRILILPSVTRNETGPYECEIRDRDGGMHSDPVTLNVLYGPDLPSIYPSFTYYRSGENLYLSCFAESNPPAEYFWTINGKFQQSGQKLSIPQITTKHRGLYTCSVRNSATGKESSKSMTVEVSVCPEVELLDQMLLQE

SEQ ID NO: 852052 - protein, 355 aa, Homo sapiens
MGPLSAPPCTQHITWKGVLLTASLLNFWNLPITAQVTIEALPPKVSEGKDVLLLVHNLPQNLAGYIWYKGQLMDLYHYITSYVVDGQINIYGPAYTGRETVYSNASLLIQNVTREDAGSYTLHIIKRGDRTRGVTGYFTFNLYLKLPKPYITINNSKPRENKDVLAFTCEPKSENYTYIWWLNGQSLPVSPRVKQPIENRILILPSVTRNETGPYECEIRDRDGGMHSDPVTLNVLYGPDLPSIYPSFTYYRSGENLYLSCFAESNPPAEYFWTINGKFQQSGQKLSIPQITTKHRGLYTCSVRNSATGKESSKSMTVEVSDSCFDSSSNYLQSPTVQNCFFFKEIYGKDSDKDS

SEQ ID NO: 852053 - protein, 335 aa, Homo sapiens; identical to SEQ ID NO: 852046

SEQ ID NO: 852054 - protein, 335 aa, Homo sapiens; identical to SEQ ID NO: 852046

SEQ ID NO: 852055 - protein, 323 aa, Homo sapiens
MGPLSAPPCTQHITWKGVLLTASLLNFWNLPITAQVTIEALPPKVSEGKDVLLLVHNLPQNLAGYIWYKGQLMDLYHYITSYVVDGQINIYGPAYTGRETVYSNASLLIQNVTREDAGSYTLHIIKRGDRTRGVTGYFTFNLYLKLPKPYITINNSKPRENKDVLAFTCEPKSENYTYIWWLNGQSLPVSPRVKQPIENRILILPSVTRNETGPYECEIRDRDGGMHSDPVTLNVLYGPDLPSIYPSFTYYRSGENLYLSCFAESNPPAEYFWTINGKFQQSGQKLSIPQITTKHRGLYTCSVRNSATGKARTLARLDTGEAR

SEQ ID NO: 852056 - protein, 335 aa, Homo sapiens; identical to SEQ ID NO: 852046

SEQ ID NO: 852057 - protein, 163 aa, Homo sapiens
MGPLSAPPCTQHITWKGVLLTASLLNFWNLPITAQVTIEALPPKVSEGKDVLLLVHNLPQNLAGYIWYKGQLMDLYHYITSYVVDGQINIYGPAYTGRETVYSNASLLIQNVTREDAGSYTLHIIKRGDRTRGVTGYFTFNLYHPAPAQAQRETHTQELSHNK

SEQ ID NO: 852058 - protein, 335 aa, Homo sapiens; identical to SEQ ID NO: 852046

SEQ ID NO: 852059 - protein, 157 aa, Homo sapiens
MWWLNGQSLPVSPRVKRPIENRILILPNVTRNETGPYQCEIRDRYGGIRSDPVTLNVLYGPDLPSIYPSFTYYRSGENLYLSCFAESNPPAEYFWTINGKFQQSGQKLSIPQITTKHRGLYTCSVRNSATGKESSKSMTVEVSAPSGIGRLPLLNPI

SEQ ID NO: 852060 - protein, 157 aa, Homo sapiens [sequence omitted]

SEQ ID NO: 852061 - protein, 355 aa, Homo sapiens; identical to SEQ ID NO: 852052

SEQ ID NO: 852062 - protein, 333 aa, Homo sapiens
MGPLSAPPCTQHITWKGVLLTASLLNFWNLPITAQVTIEALPPKVSEGKDVLLLVHNLPQNLAGYIWYKGQLMDLYHYITSYVVDGQINIYGPAYTGRETVYSNASLLIQNVTREDAGSYTLHIIKRGDRTRGVTGYFTFNLYLKLPKPYITINNSKPRENKDVLAFTCEPKSENYTYIWWLNGQSLPVSPRVKQPIENRILILPSVTRNETGPYECEIRDRDGGMHSDPVTLNVLYGPDLPSIYPSFTYYRSGENLYLSCFAESNPPAEYFWTINGKFQQSGQKLSIPQITTKHRGLYTCSVRNSATGKESSKSMTVEVSGKWIPASLAIGF

SEQ ID NO: 852063 - protein, 152 aa, Homo sapiens
MGPLSAPPCTQHITWKGVLLTASLLNFWNLPITAQVTIEALPPKVSEGKDVLLLVHNLPQNLAGYIWYKGQLMDLYHYITSYVVDGQINIYGPAYTGRETVYSNASLLIQNVTREDAGSYTLHIIKRGDRTRGVTGENPHRHGEKVQISQRH

SEQ ID NO: 852064 - protein, 227 aa, Homo sapiens
CPGNRAARGTFRPLTPPKGRAYVRRLYGGGGFGGTLRTRSQASRSGAAGVTSDLGRGLQGSEPREKALGASSHLFGSRAWGHRVVLCHPHSSSAIPPSPQNSPGTPLSCSSRPSPITVLWAPHPMTQSQASSEMLDDSRPRASPLRLFVARLVIRLHPHTGCSAGSAPFPCEARPPPCATTSVCCSCRLATSRILAWFMDQAPSFSALLLRVCPWPSASSTLRRVLE

SEQ ID NO: 852065 - protein, 495 aa, Homo sapiens
CPGNRAARGTFRPLTPPKGRAYVRRLYGGGGFGGTLRTRSQASRSGAAGVTSDLGRGLQGSEPREKALGASSHLFGSRAWGHRVVLCHPHSSSAIPPSPQNSPGTPLSCSSRPSPITVLWAPHPMTQSQASSEMLDDSRPRASPLRLFVARLVIRLHPQHRMFRWERSIPLRGSAAALCNNLSVLQLPARNLTYFGVVHGPSAQLLSAAPEGVPLAQRQLHAKEGAGVSPPLITQVHWCVLPFRVLLVLTSHRGIQMYESNGYTMVYWHALDSGDASPVQAVFARGIAASGHFICVGTWSGRVLVFDIPAKGPNIVLSEELAGHQMPITDIATEPAQGQDCVADMVTADDSGLLCVWRSGPEFTLLTRIPGFGVPCPSVQLWQGIIAAGYGNGQVHLYEATTGNLHVQINAHARAICALDLASEVGKLLSAGEDTFVHIWKLSRNPESGYIEVEHCHGECVADTQLCGARFCDSSGNSFAVTGYDLAEIRRFSSV

SEQ ID NO: 852066 - protein, 308 aa, Homo sapiens
APATAPPAARSGRSPRPRAVRTCVVSMVAADLEGPYEPGVRRADLGLQVHWCVLPFRVLLVLTSHRGIQMYESNGYTMVYWHALDSGDASPVQAVFARGIAASGHFICVGTWSGRVLVFDIPAKGPNIVLSEELAGHQMPITDIATEPAQGQDCVADMVTADDSGLLCVWRSGPEFTLLTRIPGFGVPCPSVQLWQGIIAAGYGNGQVHLYEATTGNLHVQINAHARAICALDLASEVGKLLSAGEDTFVHIWKLSRNPESGYIEVEHCHGECVADTQLCGARFCDSSGNSFAVTGYDLAEIRRFSSV

SEQ ID NO: 852067 - protein, 170 aa, Homo sapiens
MPITDIATEPAQGQDCVADMVTADDSGLLCVWRSGPEFTLLTRIPGFGVPCPSVQLWQGIIAAGYGNGQVHLYEATTGNLHVQINAHARAICALDLASEVGKLLSAGEDTFVHIWKLSRNPESGYIEVEHCHGECVADTQLCGARFCDSSGNSFAVTGYDLAEIRRFSSV

SEQ ID NO: 852068 - protein, 151 aa, Homo sapiens [sequence omitted]

SEQ ID NO: 852069 - protein, 382 aa, Homo sapiens
PRQPRRPRHVPAAHPAQGPCVRASSLWWRRIWRDPTNQESGEPIWGCRMFRWERSIPLRGSAAALCNNLSVLQLPARNLTYFGVVHGPSAQLLSAAPEGVPLAQRQLHAKEGAGVSPPLITQVHWCVLPFRVLLVLTSHRGIQMYESNGYTMVYWHALDSGDASPVQAVFARGIAASGHFICVGTWSGRVLVFDIPAKGPNIVLSEELAGHQMPITDIATEPAQGQDCVADMVTADDSGLLCVWRSGPEFTLLTRIPGFGVPCPSVQLWQGIIAAGYGNGQVHLYEATTGNLHVQINAHARAICALDLASEVGKLLSAGEDTFVHIWKLSRNPESGYIEVEHCHGECVADTQLCGARFCDSSGNSFAVTGYDLAEIRRFSSV

SEQ ID NO: 852070 - protein, 382 aa, Homo sapiens; identical to SEQ ID NO: 852069

SEQ ID NO: 852071 - protein, 375 aa, Homo sapiens
APATAPPAARSGRSPRPRAVRTCVVSMVAADLEGPYEPGVRMFRWERSIPLRGSAAALCNNLSVLQLPARNLTYFGVVHGPSAQLLSAAPEGVPLAQRQLHAKEGAGVSPPLITQVHWCVLPFRVLLVLTSHRGIQMYESNGYTMVYWHALDSGDASPVQAVFARGIAASGHFICVGTWSGRVLVFDIPAKGPNIVLSEELAGHQMPITDIATEPAQGQDCVADMVTADDSGLLCVWRSGPEFTLLTRIPGFGVPCPSVQLWQGIIAAGYGNGQVHLYEATTGNLHVQINAHARAICALDLASEVGKLLSAGEDTFVHIWKLSRNPESGYIEVEHCHGECVADTQLCGARFCDSSGNSFAVTGYDLAEIRRFSSV

SEQ ID NO: 852072 - protein, 239 aa, Homo sapiens [sequence omitted]

SEQ ID NO: 852073 - protein, 193 aa, Homo sapiens
MVCYVNTRGGAQWGRGSHLNYTTRAAGGDENTTRWRERGKQPPEPEGILANEAETTTRRAGDRGTRGATPPTKEDPKARRGQNTIGRCIEGDHHQAEQSPGGRKNLGPAAISGRHNYTRARVTEKTAATHETQPGIKQTDTVAAMQQTEDNKEEKTQRTDAMQDANNRDSGHTQSTTADAQDHEQKQPARENT

SEQ ID NO: 852074 - protein, 199 aa, Homo sapiens
AESCPAAFSPVATVLTGPVVPRERMNLKVPIYFSTGLTEKANHYYKLFIPWTNQKIRKTFVQRNMFEFKHIKAFDRAFADNPGPMVVFATPGMLHAGQSLQIFRKWAGNEKNMGEGMVRCGNLEAGGRRVVLPPMLSLSSHWLGLVLAKGRGCCCWGTGAMSAWSCSVSVTQLVHLGQNSPSPALDSLVPKPEPFGVCS

SEQ ID NO: 852075 - protein, 527 aa, Homo sapiens
TGSCSEVVAPAQCITAGGPRGSGSAAETMPEIRVTPLGAGQDVGRSCILVSIAGKNVMLDCGMHMGFNDDVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 852076 - protein, 606 aa, Homo sapiens
TGSCSEVVAPAQCITAGGPRGSGSAAETMPEIRVTPLGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCMKKVVAVHLHQTVQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 852077 - protein, 518 aa, Homo sapiens [sequence omitted]

SEQ ID NO: 852078 - protein, 470 aa, Homo sapiens
MIAPLQPGDSPTLSLNFIYLFFFETQSRSVAQAGVQWRDLGLLQPPPPGFKQFSCLSLPSSWDYRRTPPHPANFVFLVETGFFRVGQAGLEFPPQMICPPWSPQVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 852079 - protein, 431 aa, Homo sapiens
VGALAEVDCHFDPQNRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 852080 - protein, 518 aa, Homo sapiens [sequence omitted]

SEQ ID NO: 852081 - protein, 498 aa, Homo sapiens
MIAPLQPGDSPTLSLNFIYLFFFETQSRSVAQAGVQWRDLGLLQPPPPGFKQFSCLSLPSSWDYRRTPPHPANFVFLVETGFFRVGQAGLEFPPQMICPPWSPQVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVVSLDPALGWQGRGAPPGGNHCPRPVASVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 852082 - protein, 572 aa, Homo sapiens
MVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGMGLGRAGQGARGRRLGAALTLMAPATSSAGLLPEAKKPRLLHGTLIMKDSVSARTVSGGGRAAAALTDLSLPHRNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 852083 - protein, 399 aa, Homo sapiens
MIAPLQPGDSPTLSLNFIYLFFFETQSRSVAQAGVQWRDLGLLQPPPPGFKQFSCLSLPSSWDYRRTPPHPANFVFLVETGFFRVGQAGLEFPPQMICPPWSPQVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 852084 - protein, 492 aa, Homo sapiens
MVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSPSEDPGTKVLLVSWTYQDEELGSFLTSLLKKGLPQAPS

SEQ ID NO: 852085 - protein, 551 aa, Homo sapiens
MIAPLQPGDSPTLSLNFIYLFFFETQSRSVAQAGVQWRDLGLLQPPPPGFKQFSCLSLPSSWDYRRTPPHPANFVFLVETGFFRVGQAGLEFPPQMICPPWSPQVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVVSLDPALGWQGRGAPPGGNHCPRPVASVLEVKMQVEYMSFSAHADAKGIMQLVGQAEPESVLLVHGEAKKMEFLKQKIEQELRRQPGGRRGAHLGSARAAWAEALLFPRGPGVNCYMPANGETVTLPTSPSIPVGISLGLLKREMAQGLLPEAKKPRLLHGTLIMKDSVSARTVSGGGRAAAALTDLSLPHRNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 852086 - protein, 243 aa, Homo sapiens
FVQLGTPPQQTQLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 852087 - protein, 464 aa, Homo sapiens
MVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGCPGPEALVLADPVMRNRLPGGVSEKPQSWSLRQWFPAGAVAAGEGVVAQVGAGVPRVGGGPGAFGAGGVPGVLGRRGP

SEQ ID NO: 852088 - protein, 135 aa, Homo sapiens
TGSCSEVVAPAQCITAGGPRGSGSAAETMPEIRVTPLGAGQDVGRSCILVSIAGKNVMLDCGMHMGFNDDVSPLGRRPRGWESRPSTAGPWASEPGQWGGGQQWLCLDGCTLWGAGMGGPGRGEPLHGGVPLCWR

SEQ ID NO: 852089 - protein, 135 aa, Homo sapiens; identical to SEQ ID NO: 852088

SEQ ID NO: 852090 - protein, 628 aa, Homo sapiens
TGSCSEVVAPAQCITAGGPRGSGSAAETMPEIRVTPLGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 852091 - protein, 421 aa, Homo sapiens
TGSCSEVVAPAQCITAGGPRGSGSAAETMPEIRVTPLGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 852092 - protein, 545 aa, Homo sapiens
MVGYDGPIYMTHPTQAICPILLEDYRKIAVDKKGEANFFTSQMIKDCMKKVVAVHLHQTVQVDDELEIKAYYAGHVLGAAMFQIKVGSESVVYTVSGRAGGLGGAAGVGGTLLMASLIVHQGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 852093 - protein, 435 aa, Homo sapiens
MQATCWGQPCSRLKWAQSLWSTRAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 852094 - protein, 518 aa, Homo sapiens [sequence omitted]

SEQ ID NO: 852095 - protein, 518 aa, Homo sapiens [sequence omitted]

SEQ ID NO: 852096 - protein, 402 aa, Homo sapiens
MVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQELPAGVLRASPQRAGSG

SEQ ID NO: 852097 - protein, 518 aa, Homo sapiens [sequence omitted]

SEQ ID NO: 852098 - protein, 452 aa, Homo sapiens
MVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKETRSWGASSHLC

SEQ ID NO: 852099 - protein, 447 aa, Homo sapiens
MVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 852100 - protein, 553 aa, Homo sapiens
MVGYDGPIYMTHPTQAICPILLEDYRKIAVDKKGEANFFTSQMIKDCMKKVVAVHLHQTVQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVVSLDPALGWQGRGAPPGGNHCPRPVASVLEVKMQVEYMSFSAHADAKGIMQLVGQAEPESVLLVHGEAKKMEFLKQKIEQELRRQPGGRRGAHLGSARAAWAEALIFPRGPGVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 852101 - protein, 135 aa, Homo sapiens; identical to SEQ ID NO: 852088

SEQ ID NO: 852102 - protein, 2969 aa, Homo sapiens [sequence omitted]

SEQ ID NO: 852103 - protein, 2952 aa, Homo sapiens
MDPRNTAMLGLGSDSEGFSRKSPSAISTGTLVSKREVELEKNTKEEEDLRKRNRERNIEAGKDDGLTDAQQQFSVKETNFSEGNLKLKIGLQAKRTKKPPKNLENYVCRPAIKTTIKHPRKALKSGKMTDEKNEHCPSKRDPSKLYKKADDVAAIECQSEEVIRLHSQGENNPLSKKLSPVHSEMADYINATPSTLLGSRDPDLKDRALLNGGTSVTEKLAQLIATCPPSKSSKTKPKKLGTGTTAGLVSKDLIRKAGVGSVAGIIHKDLIKKPTISTAVGLVTKDPGKKPVFNAAVGLVNKDSVKKLGTGTTAVFINKNLGKKPGTITTVGLLSKDSGKKLGIGIVPGLVHKESGKKLGLGTVVGLVNKDLGKKLGSTVGLVAKDCAKKIVASSAMGLVNKDIGKKLMSCPLAGLISKDAINLKAEALLPTQEPLKASCSTNINNQESQELSESLKDSATSKTFEKNVVRQNKESILEKFSVRKEIINLEKEMFNEGTCIQQDSFSSSEKGSYETSKHEKQPPVYCTSPDFKMGGASDVSTAKSPFSAVGESNLPSPSPTVSVNPLTRSPPETSSQLAPNPLLLSSTTELIEEISESVGKNQFTSESTHLNVGHRSVGHSISIECKGIDKEVNDSKTTHIDIPRISSSLGKKPSLTSESSIHTITPSVVNFTSLFSNKPFLKLGAVSASDKHCQVAESLSTSLQSKPLKKRKGRKPRWTKVVARSTCRSPKGLELERSELFKNVSCSSLSNSNSEPAKFMKNIGPPSFVDHDFLKRRLPKLSKSTAPSLALLADSEKPSHKSFATHKLSSSMCVSSDLLSDIYKPKRGRPKSKEMPQLEGPPKRTLKIPASKVFSLQSKEEQEPPILQPEIEIPSFKQGLSVSPFPKKRGRPKRQMRSPVKMKPPVLSVAPFVATESPSKLESESDNHRSSSDFFESEDQLQDPDDLDDSHRPSVCSMSDLEMEPDKKITKRNNGQLMKTIIRKINKMKTLKRKKLLNQILSSSVESSNKGKVQSKLHNTVSSLAATFGSKLGQQINVSKKGTIYIGKRRGRKPKTVLNGILSGSPTSLAVLEQTAQQAAGSALGQILPPLLPSSASSSEILPSPICSQSSGTSGGQSPVSSDAGFVEPSSVPYLHLHSRQGSMIQTLAMKKASKGRRRLSPPTLLPNSPSHLSELTSLKEATPSPISESHSDETIPSDSGIGTDNNSTSDRAEKFCGQKKRRHSFEHVSLIPPETSTVLSSLKEKHKHKCKRRNHDYLSYDKMKRQKRKRKKKYPQLRNRQDPDFIAELEELISRLSEIRITHRSHHFIPRDLLPTIFRINFNSFYTHPSFPLDPLHYIRKPDLKKKRGRPPKMREAMAEMPFMHSLSFPLSSTGFYPSYGMPYSPSPLTAAPIGLGYYGRYPPTLYPPPPSPSFTTPLPPPSYMHAGHLLLNPAKYHKKKHKLLRQEAFLTTSRTPLLSMSTYPSVPPEMAYGWMVEHKHRHRHKHREHRSSEQPQVSMDTGSSRSVLESLKRYRFGKDAVGERYKHKEKHRCHMSCPHLSPSKSLINREEQWVHREPSESSPLALGLQTPLQIDCSESSPSLSLGGFTPNSEPASSDEHTNLFTSAIGSCRVSNPNSSGRKKLTDSPGLFSAQDTSLNRLHRKESLPSNERAVQTLAGSQPTSDKPSQRPSESTNCSPTRKRSSSESTSSTVNGVPSRSPRLVASGDDSVDSLLQRMVQNEDQEPMEKSIDAVIATASAPPSSSPGRSHSKDRTLGKPDSLLVPAVASDSCNNSISLLSEKLTSSCSPHHIKRSVVEAMQRQARKMCNYDKILATKKNLDHVNKILKAKKLQRQARTGNNFVKRRPGRPRKCPLQAVVSMQAFQAAQFVNPELNRDEEGAALHLSPDTVTDVIEAVVQSVNLNPEHKKGLKRKGWLLEEQTRKKQKPLPEEEEQENNKSFNEAPVEIPSPSETPAKPSEPESTLQPVLSLIPREKKPPRPPKKKYQKAGLYSDVYKTTDPKSRLIQLKKEKLEYTPGEHEYGLFPAPIHVVFFVSGKYLRQKRIDFQLPYDILWQWKHNQLYKKPDVPLYKKIRSNVYVDVKPLSGYEATTCNCKKPDDDTRKGCVDDCLNRMIFAECSPNTCPCGEQCCNQRIQRHEWVQCLERFRAEEKGWGIRTKEPLKAGQFIIEYLGEVVSEQEFRNRMIEQYHNHSDHYCLNLDSGMVIDSYRMGNEARFINHSCDPNCEMQKWSVNGVYRIGLYALKDMPAGTELTYDYNFHSFNVEKQQLCKCGFEKCRGIIGGKSQRVNGLTSSKNSQPMATHKKSGRSKEKRKSKHKLKKRRGHLSEEPSENINTPTRLTPQLQMKPMSNRERNFVLKHHVFLVRNWEKIRQKQEEVKHTSDNIHSASLYTRWNGICRDDGNIKSDVFMTQFSALQTARSVRTRRLAAAEENIEVARAARLAQIFKEICDGIISYKDSSRQALAAPLLNLPPKKKNADYYEKISDPLDLITIEKQILTGYYKTVEAFDADMLKVFRNAEKYYGRKSPVGRDVCRLRKAYYNARHEASAQIDEIVGETASEADSSETSVSEKENGHEKDDDVIRCICGLYKDEGLMIQCDKCMVWQHCDCMGVNSDVEHYLCEQCDPRPVDREVPMIPRPHYAQPGCVYFICLLRDDLLLRQGDCVYLMRDSRRTPDGHPVRQSYRLLSHINRDKLDIFRIEKLWKNENHSPSRRFYHNELFRVPLYEIIPLEAVVGTCCVLDLYTYCKGRPKGVKEQDVYICDYRLDKSAHLFYKIHRNRYPVCTKPYAFDHFPKKLTPKKDFSPHYVPDNYKRNGGRSSWKSERSKPPLKDLGQEDDALPLIEEVLASQEQAANEIPSLEEPEREGATANVSEGEKKTEESSQEPQSTCTPEERRHNQRERLNQILLNLLEKIPGKNAIDVTYLLEEGSGRKLRRRTLFIPENSFRK

SEQ ID NO: 852104 - protein, 2969 aa, Homo sapiens [sequence omitted]

SEQ ID NO: 852105 - protein, 2969 aa, Homo sapiens [sequence omitted]

SEQ ID NO: 852106 - protein, 621 aa, Homo sapiens
MKPMSNRERNFVLKHHVFLVRNWEKIRQKQEEVKHTSDNIHSASLYTRWNGICRDDGNIKSDVFMTQFSALQTARSVRTRRLAAAEENIEVARAARLAQIFKEICDGIISYKDSSRQALAAPLLNLPPKKKNADYYEKISDPLDLITIEKQILTGYYKTVEAFDADMLKVFRNAEKYYGRKSPVGRDVCRLRKAYYNARHEASAQIDEIVGETASEADSSETSVSEKENGHEKDDDVIRCICGLYKDEGLMIQCDKCMVWQHCDCMGVNSDVEHYLCEQCDPRPVDREVPMIPRPHYAQPGCVYFICLLRDDLLLRQGDCVYLMRDSRRTPDGHPVRQSYRLLSHINRDKLDIFRIEKLWKNEKEERFAFGHHYFRPHETHHSPSRRFYHNELFRVPLYEIIPLEAVVGTCCVLDLYTYCKGRPKGVKEQDVYICDYRLDKSAHLFYKIHRNRYPVCTKPYAFDHFPKKLTPKKDFSPHYVPDNYKRNGGRSSWKSERSKPPLKDLGQEDDALPLIEEVLASQEQAANEIPSLEEPEREGATANVSEGEKKTEESSQEPQSTCTPEERRHNQRERLNQILLNLLEKIPGKNAIDVTYLLEEGSGRKLRRRTLFIPENSFRK

SEQ ID NO: 852107 - protein, 123 aa, Homo sapiens
GGARRPSLPPSGGAAAATAATLLLPPPPPPLPPPFWVRFAEGRRSQSRLRDPPPLSLPPLAFHLSLLLSRISASQLTRWPPPDKREGSAVDPGKRRSLAATPSSPLPCTLIALGLGLGLRHGE

SEQ ID NO: 852108 - protein, 423 aa, Homo sapiens
MDPRNTAMLGLGSDSEGFSRKSPSAISTGTLVSKREVELEKNTKEEEDLRKRNRERNIEAGKDDGLTDAQQQFSVKETNFSEGNLKLKIGLQAKRTKKPPKNLENYVCRPAIKTTIKHPRKALKSGKMTDEKNEHCPSKRDPSKLYKKADDVAAIECQSEEVIRLHSQGENNPLSKKLSPVHSEMADYINATPSTLLGSRDPDLKDRALLNGGTSVTEKLAQLIATCPPSKSSKTKPKKLGTGTTAGLVSKDLIRKAGVGSVAGIIHKDLIKKPTISTAVGLVTKDPGKKPVFNAAVGLVNKDSVKKLGTGTTAVFINKNLGKKPGTITTVGLLSKDSGKKLGIGIVPGLVHKESGKKLGLGTVVGLVNKDLGKKLGSTVGLVAKDCAKKIVASSAMGLVNKDIGKKLMSCPLAGLISKDAIT

SEQ ID NO: 852109 - protein, 2969 aa, Homo sapiens [sequence omitted]

SEQ ID NO: 852110 - protein, 2771 aa, Homo sapiens
MDPRNTAMLGLGSDSEGFSRKSPSAISTGTLVSKREVELEKNTKEEEDLRKRNRERNIEAGKDDGLTDAQQQFSVKETNFSEGNLKLKIGLQAKRTKKPPKNLENYVCRPAIKTTIKHPRKALKSGKMTDEKNEHCPSKRDPSKLYKKADDVAAIECQSEEVIRLHSQGENNPLSKKLSPVHSEMADYINATPSTLLGSRDPDLKDRALLNGGTSVTEKLAQLIATCPPSKSSKTKPKKLGTGTTAGLVSKDLIRKAGVGSVAGIIHKDLIKKPTISTAVGLVTKDPGKKPVFNAAVGLVNKDSVKKLGTGTTAVFINKNLGKKPGTITTVGLLSKDSGKKLGIGIVPGLVHKESGKKLGLGTVVGLVNKDLGKKLGSTVGLVAKDCAKKIVASSAMGLVNKDIGKKLMSCPLAGLISKDAINLKAEALLPTQEPLKASCSTNINNQESQELSESLKDSATSKTFEKNVVRQNKESILEKFSVRKEIINLEKEMFNEGTCIQQDSFSSSEKGSYETSKHEKQPPVYCTSPDFKMGGASDVSTAKSPFSAVGESNLPSPSPTVSVNPLTRSPPETSSQLAPNPLLLSSTTELIEEISESVGKNQFTSESTHLNVGHRSVGHSISIECKGIDKEVNDSKTTHIDIPRISSSLGKKPSLTSESSIHTITPSVVNFTSLFSNKPFLKLGAVSASDKHCQVAESLSTSLQSKPLKKRKGRKPRWTKVVARSTCRSPKGLELERSELFKNVSCSSLSNSNSEPAKFMKNIGPPSFVDHDFLKRRLPKLSKSTAPSLALLADSEKPSHKSFATHKLSSSMCVSSDLLSDIYKPKRGRPKSKEMPQLEGPPKRTLKIPASKVFSLQSKEEQEPPILQPEIEIPSFKQGLSVSPFPKKRGRPKRQMRSPVKMKPPVLSVAPFVATESPSKLESESDNHRSSSDFFESEDQLQDPDDLDDSHRPSVCSMSDLEMEPDKKITKRNNGQLMKTIIRKINKMKTLKRKKLLNQILSSSVESSNKGKVQSKLHNTVSSLAATFGSKLGQQINVSKKGTIYIGKRRGRKPKTVLNGILSGSPTSLAVLEQTAQQAAGSALGQILPPLLPSSASSSEILPSPICSQSSGTSGGQSPVSSDAGFVEPSSVPYLHLHSRQGSMIQTLAMKKASKGRRRLSPPTLLPNSPSHLSELTSLKEATPSPISESHSDETIPSDSGIGTDNNSTSDRAEKFCGQKKRRHSFEHVSLIPPETSTVLSSLKEKHKHKCKRRNHDYLSYDKMKRQKRKRKKKYPQLRNRQDPDFIAELEELISRLSEIRITHRSHHFIPRDLLPTIFRINFNSFYTHPSFPLDPLHYIRKPDLKKKRGRPPKMREAMAEMPFMHSLSFPLSSTGFYPSYGMPYSPSPLTAAPIGLGYYGRYPPTLYPPPPSPSFTTPLPPPSYMHAGHLLLNPAKYHKKKHKLLRQEAFLTTSRTPLLSMSTYPSVPPEMAYGWMVEHKHRHRHKHREHRSSEQPQVSMDTGSSRSVLESLKRYRFGKDAVGERYKHKEKHRCHMSCPHLSPSKSLINREEQWVHREPSESSPLALGLQTPLQIDCSESSPSLSLGGFTPNSEPASSDEHTNLFTSAIGSCRVSNPNSSGRKKLTDSPGLFSAQDTSLNRLHRKESLPSNERAVQTLAGSQPTSDKPSQRPSESTNCSPTRKRSSSESTSSTVNGVPSRSPRLVASGDDSVDSLLQRMVQNEDQEPMEKSIDAVIATASAPPSSSPGRSHSKDRTLGKPDSLLVPAVASDSCNNSISLLSEKLTSSCSPHHIKRSVVEAMQRQARKMCNYDKILATKKNLDHVNKILKAKKLQRQARTGNNFVKRRPGRPRKCPLQAVVSMQAFQAAQFVNPELNRDEEGAALHLSPDTVTDVIEAVVQSVNLNPEHKKGLKRKGWLLEEQTRKKQKPLPEEEEQENNKSFNEAPVEIPSPSETPAKPSEPESTLQPVLSLIPREKKPPRPPKKKYQKAGLYSDVYKTTDPKSRLIQLKKEKLEYTPGEHEYGLFPAPIHVVFFVSGKYLRQKRIDFQLPYDILWQWKHNQLYKKPDVPLYKKIRSNVYVDVKPLSGYEATTCNCKKPDDDTRKGCVDDCLNRMIFAECSPNTCPCGEQCCNQRIQRHEWVQCLERFRAEEKGWGIRTKEPLKAGQFIIEYLGEVVSEQEFRNRMIEQYHNHSDHYCLNLDSGMVIDSYRMGNEARFINHSCDPNCEMQKWSVNGVYRIGLYALKDMPAGTELTYDYNFHSFNVEKQQLCKCGFEKCRGIIGGKSQRVNGLTSSKNSQPMATHKKSGRSKEKRKSKHKLKKRRGHLSEEPSENINTPTRLTPQLQMKPMSNRERNFVLKHHVFLVRNWEKIRQKQEEVKHTSDNIHSASLYTRWNGICRDDGNIKSDVFMTQFSALQTARSVRTRRLAAAEENIEVARAARLAQIFKEICDGIISYKDSSRQALAAPLLNLPPKKKNADYYEKISDPLDLITIEKQILTGYYKTVEAFDADMLKVFRNAEKYYGRKSPVGRDVCRLRKAYYNARHEASAQIDEIVGETASEADSSETSVSEKENGHEKDDDVIRCICGLYKDEGLMIQCDKCMVWQHCDCMGVNSDVEHYLCEQCDPRPVDREVPMIPRPHYAQPGCVYFICLLRDDLLLRQGDCVYLMRDSRRTPDGHPVRQSYRLLSHINRDKLDIFRIEKLWKNEKEERFAFGHHYFRPHETHHSPSRRFYHNELFRVPLYEIIPLEAVVGTCCVLDLYTYCKGK

SEQ ID NO: 852111 - protein, 2234 aa, Homo sapiens
MDPRNTAMLGLGSDSEGFSRKSPSAISTGTLVSKREVELEKNTKEEEDLRKRNRERNIEAGKDDGLTDAQQQFSVKETNFSEGNLKLKIGLQAKRTKKPPKNLENYVCRPAIKTTIKHPRKALKSGKMTDEKNEHCPSKRDPSKLYKKADDVAAIECQSEEVIRLHSQGENNPLSKKLSPVHSEMADYINATPSTLLGSRDPDLKDRALLNGGTSVTEKLAQLIATCPPSKSSKTKPKKLGTGTTAGLVSKDLIRKAGVGSVAGIIHKDLIKKPTISTAVGLVTKDPGKKPVFNAAVGLVNKDSVKKLGTGTTAVFINKNLGKKPGTITTVGLLSKDSGKKLGIGIVPGLVHKESGKKLGLGTVVGLVNKDLGKKLGSTVGLVAKDCAKKIVASSAMGLVNKDIGKKLMSCPLAGLISKDAINLKAEALLPTQEPLKASCSTNINNQESQELSESLKDSATSKTFEKNVVRQNKESILEKFSVRKEIINLEKEMFNEGTCIQQDSFSSSEKGSYETSKHEKQPPVYCTSPDFKMGGASDVSTAKSPFSAVGESNLPSPSPTVSVNPLTRSPPETSSQLAPNPLLLSSTTELIEEISESVGKNQFTSESTHLNVGHRSVGHSISIECKGIDKEVNDSKTTHIDIPRISSSLGKKPSLTSESSIHTITPSVVNFTSLFSNKPFLKLGAVSASDKHCQVAESLSTSLQSKPLKKRKGRKPRWTKVVARSTCRSPKGLELERSELFKNVSCSSLSNSNSEPAKFMKNIGPPSFVDHDFLKRRLPKLSKSTAPSLALLADSEKPSHKSFATHKLSSSMCVSSDLLSDIYKPKRGRPKSKEMPQLEGPPKRTLKIPASKVFSLQSKEEQEPPILQPEIEIPSFKQGLSVSPFPKKRGRPKRQMRSPVKMKPPVLSVAPFVATESPSKLESESDNHRSSSDFFESEDQLQDPDDLDDSHRPSVCSMSDLEMEPDKKITKRNNGQLMKTIIRKINKMKTLKRKKLLNQILSSSVESSNKGKVQSKLHNTVSSLAATFGSKLGQQINVSKKGTIYIGKRRGRKPKTVLNGILSGSPTSLAVLEQTAQQAAGSALGQILPPLLPSSASSSEILPSPICSQSSGTSGGQSPVSSDAGFVEPSSVPYLHLHSRQGSMIQTLAMKKASKGRRRLSPPTLLPNSPSHLSELTSLKEATPSPISESHSDETIPSDSGIGTDNNSTSDRAEKFCGQKKRRHSFEHVSLIPPETSTVLSSLKEKHKHKCKRRNHDYLSYDKMKRQKRKRKKKYPQLRNRQDPDFIAELEELISRLSEIRITHRSHHFIPRDLLPTIFRINFNSFYTHPSFPLDPLHYIRKPDLKKKRGRPPKMREAMAEMPFMHSLSFPLSSTGFYPSYGMPYSPSPLTAAPIGLGYYGRYPPTLYPPPPSPSFTTPLPPPSYMHAGHLLLNPAKYHKKKHKLLRQEAFLTTSRTPLLSMSTYPSVPPEMAYGWMVEHKHRHRHKHREHRSSEQPQVSMDTGSSRSVLESLKRYRFGKDAVGERYKHKEKHRCHMSCPHLSPSKSLINREEQWVHREPSESSPLALGLQTPLQIDCSESSPSLSLGGFTPNSEPASSDEHTNLFTSAIGSCRVSNPNSSGRKKLTDSPGLFSAQDTSLNRLHRKESLPSNERAVQTLAGSQPTSDKPSQRPSESTNCSPTRKRSSSESTSSTVNGVPSRSPRLVASGDDSVDSLLQRMVQNEDQEPMEKSIDAVIATASAPPSSSPGRSHSKDRTLGKPDSLLVPAVASDSCNNSISLLSEKLTSSCSPHHIKRSVVEAMQRQARKMCNYDKILATKKNLDHVNKILKAKKLQRQARTGNNFVKRRPGRPRKCPLQAVVSMQAFQAAQFVNPELNRDEEGAALHLSPDTVTDVIEAVVQSVNLNPEHKKGLKRKGWLLEEQTRKKQKPLPEEEEQENNKSFNEAPVEIPSPSETPAKPSEPESTLQPVLSLIPREKKPPRPPKKKYQKAGLYSDVYKTTDPKSRLIQLKKEKLEYTPGEHEYGLFPAPIHVVFFVSGKYLRQKRIDFQLPYDILWQWKHNQLYKKPDVPLYKKIRSNVYVDVKPLSGYEATTCNCKKPDDDTRKGCVDDCLNRMIFAECSPNTCPCGEQCCNQRIQRHEWVQCLERFRAEEKGWGIRTKEPLKAGQFIIEYLGEVVSEQEFRNRMIEQYHNHSDHYCLNLDSGMVIDSYRMGNEARFINHSCDPNCEMQKW

SEQ ID NO: 852112 - protein, 2209 aa, Homo sapiens
MKNIGPPSFVDHDFLKRRLPKLSKSTAPSLALLADSEKPSHKSFATHKLSSSMCVSSDLLSDIYKPKRGRPKSKEMPQLEGPPKRTLKIPASKVFSLQSKEEQEPPILQPEIEIPSFKQGLSVSPFPKKRGRPKRQMRSPVKMKPPVLSVAPFVATESPSKLESESDNHRSSSDFFESEDQLQDPDDLDDSHRPSVCSMSDLEMEPDKKITKRNNGQLMKTIIRKINKMKTLKRKKLLNQILSSSVESSNKGKVQSKLHNTVSSLAATFGSKLGQQINVSKKGTIYIGKRRGRKPKTVLNGILSGSPTSLAVLEQTAQQAAGSALGQILPPLLPSSASSSEILPSPICSQSSGTSGGQSPVSSDAGFVEPSSVPYLHLHSRQGSMIQTLAMKKASKGRRRLSPPTLLPNSPSHLSELTSLKEATPSPISESHSDETIPSDSGIGTDNNSTSDRAEKFCGQKKRRHSFEHVSLIPPETSTVLSSLKEKHKHKCKRRNHDYLSYDKMKRQKRKRKKKYPQLRNRQDPDFIAELEELISRLSEIRITHRSHHFIPRDLLPTIFRINFNSFYTHPSFPLDPLHYIRKPDLKKKRGRPPKMREAMAEMPFMHSLSFPLSSTGFYPSYGMPYSPSPLTAAPIGLGYYGRYPPTLYPPPPSPSFTTPLPPPSYMHAGHLLLNPAKYHKKKHKLLRQEAFLTTSRTPLLSMSTYPSVPPEMAYGWMVEHKHRHRHKHREHRSSEQPQVSMDTGSSRSVLESLKRYRFGKDAVGERYKHKEKHRCHMSCPHLSPSKSLINREEQWVHREPSESSPLALGLQTPLQIDCSESSPSLSLGGFTPNSEPASSDEHTNLFTSAIGSCRVSNPNSSGRKKLTDSPGLFSAQDTSLNRLHRKESLPSNERAVQTLAGSQPTSDKPSQRPSESTNCSPTRKRSSSESTSSTVNGVPSRSPRLVASGDDSVDSLLQRMVQNEDQEPMEKSIDAVIATASAPPSSSPGRSHSKDRTLGKPDSLLVPAVASDSCNNSISLLSEKLTSSCSPHHIKRSVVEAMQRQARKMCNYDKILATKKNLDHVNKILKAKKLQRQARTGNNFVKRRPGRPRKCPLQAVVSMQAFQAAQFVNPELNRDEEGAALHLSPDTVTDVIEAVVQSVNLNPEHKKGLKRKGWLLEEQTRKKQKPLPEEEEQENNKSFNEAPVEIPSPSETPAKPSEPESTLQPVLSLIPREKKPPRPPKKKYQKAGLYSDVYKTTDPKSRLIQLKKEKLEYTPGEHEYGLFPAPIHVVFFVSGKYLRQKRIDFQLPYDILWQWKHNQLYKKPDVPLYKKIRSNVYVDVKPLSGYEATTCNCKKPDDDTRKGCVDDCLNRMIFAECSPNTCPCGEQCCNQRIQRHEWVQCLERFRAEEKGWGIRTKEPLKAGQFIIEYLGEVVSEQEFRNRMIEQYHNHSDHYCLNLDSGMVIDSYRMGNEARFINHSCDPNCEMQKWSVNGVYRIGLYALKDMPAGTELTYDYNFHSFNVEKQQLCKCGFEKCRGIIGGKSQRVNGLTSSKNSQPMATHKKSGRSKEKRKSKHKLKKRRGHLSEEPSENINTPTRLTPQLQMKPMSNRERNFVLKHHVFLVRNWEKIRQKQEEVKHTSDNIHSASLYTRWNGICRDDGNIKSDVFMTQFSALQTARSVRTRRLAAAEENIEVARAARLAQIFKEICDGIISYKDSSRQALAAPLLNLPPKKKNADYYEKISDPLDLITIEKQILTGYYKTVEAFDADMLKVFRNAEKYYGRKSPVGRDVCRLRKAYYNARHEASAQIDEIVGETASEADSSETSVSEKENGHEKDDDVIRCICGLYKDEGLMIQCDKCMVWQHCDCMGVNSDVEHYLCEQCDPRPVDREVPMIPRPHYAQPGCVYFICLLRDDLLLRQGDCVYLMRDSRRTPDGHPVRQSYRLLSHINRDKLDIFRIEKLWKNEKEERFAFGHHYFRPHETHHSPSRRFYHNELFRVPLYEIIPLEAVVGTCCVLDLYTYCKGRPKGVKEQDVYICDYRLDKSAHLFYKIHRNRYPVCTKPYAFDHFPKKLTPKKDFSPHYVPDNYKRNGGRSSWKSERSKPPLKDLGQEDDALPLIEEVLASQEQAANEIPSLEEPEREGATANVSEGEKKTEESSQEPQSTCTPEERRHNQRERLNQILLNLLEKIPGKNAIDVTYLLEEGSGRKLRRRTLFIPENSFRK

SEQ ID NO: 852113 - protein, 123 aa, Homo sapiens; identical to SEQ ID NO: 852107

SEQ ID NO: 852114 - protein, 333 aa, Homo sapiens
GGARRPSLPPSGGAAAATAATLLLPPPPPPLPPPFWVRFAEGRRSQSRLRDPPPLSLPPLAFHLSLLLSRISASQLTRWPPPDKREGSAVDPGKRRSLAATPSSPLPCTLIALGHPTTEHREANAAAHATRSCCRNQTRVYAMFWQLIRLTVIFLAVNLPEVLELPVPQMQHGHSPNMDRCMAQKRRSVWLSLTLTLTPLKLYGFEELLANLPKLNNTHDSRTDTHPTPADTTDRTPSAHTTPDRAALAPGPPPQLQRAVPLKHRLPFLATQHPQRDRRLPPRHDCHASTCFQASSEHHNLPQPLCAPPPGHNPHTSPHFARTRPKLHHPTAS

SEQ ID NO: 852115 - protein, 476 aa, Homo sapiens
MAFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 852116 - protein, 346 aa, Homo sapiens
MAFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLSK

SEQ ID NO: 852117 - protein, 399 aa, Homo sapiens
MCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 852118 - protein, 472 aa, Homo sapiens
KCTFLSMPPGEWNQTEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 852119 - protein, 459 aa, Homo sapiens
MAFGKSHRDPYATSVGHLIEKATFAGVQTEDWGQFMHICDIINTTQDGPKDAVKALKLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 852120 - protein, 426 aa, Homo sapiens
MAFGKSHRDPYATSVGHLIEKATFAGVQTEDWGQFMHICDIINTTQDGPKDAVKALKKRISKNYNHKEIQLTLSTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 852121 - protein, 441 aa, Homo sapiens
MAFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQEIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 852122 - protein, 180 aa, Homo sapiens
MAFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQEISRSPRPKSQSPDA

SEQ ID NO: 852123 - protein, 346 aa, Homo sapiens; identical to SEQ ID NO: 852116

SEQ ID NO: 852124 - protein, 465 aa, Homo sapiens
MAFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNPVSLQTIAAAPSNQSLPPLPSNHPAMTKSDLQPPNYYEVMEFDPLAPAVTTEAIYEEIDAHQHKGAQNDGD

SEQ ID NO: 852125 - protein, 476 aa, Homo sapiens; identical to SEQ ID NO: 852115

SEQ ID NO: 852126 - protein, 371 aa, Homo sapiens
VRIFQLRRTLQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 852127 - protein, 203 aa, Homo sapiens
MAFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQVY

SEQ ID NO: 852128 - protein, 100 aa, Homo sapiens
DSSSVPQLQQLQYNSYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 852129 - protein, 469 aa, Homo sapiens
MAFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEYIFQLQTYVRRI

SEQ ID NO: 852130 - protein, 165 aa, Homo sapiens
MDEEPERTKRWEGGYERTWEILKEDESGSLKATIEDILFKAKRKRVFEHHGQVRLGMMRHLYVVVDGSRTMEDQDLKPNRLTCTLKLLEYFVEEYFDQNPISQIGIIVTKSKRAEKLTELSGNPRKHITSLKKAVDMTCHGEPSLYNSLSMAMQTLKLVLYIMYN

SEQ ID NO: 852131 - protein, 104 aa, Homo sapiens
MTCHGEPSLYNSLSMAMQTLKHMPGHTSREVLIIFSSLTTCDPSNIYDLIKTLKAAKIRVSVIGLSAEVRVCTVLARETGARTMATTSSTMICVTKGYGCSACA

SEQ ID NO: 852132 - protein, 395 aa, Homo sapiens [sequence omitted]

SEQ ID NO: 852133 - protein, 395 aa, Homo sapiens [sequence omitted]

SEQ ID NO: 852134 - protein, 338 aa, Homo sapiens
MRHLYVVVDGSRTMEDQDLKPNRLTCTLKLLEYFVEEYFDQNPISQIGIIVTKSKRAEKLTELSGNPRKHITSLKKAVDMTCHGEPSLYNSLSMAMQTLKHMPGHTSREVLIIFSSLTTCDPSNIYDLIKTLKAAKIRVSVIGLSAEVRVCTVLARETGGTYHVILDESHYKELLTHHVSPPPASSSSECSLIRMGFPQHTIASLSDQDAKPSFSMAHLDGNTEPGLTLGGYFCPQCRAKYCELPVECKICGLTLVSAPHLARSYHHLFPLDAFQEIPLEEYNGERFCYGCQGELKDQHVYVCAVCQNVFCVDCDVFVHDSLHCCPGCIHKIPAPSGV

SEQ ID NO: 852135 - protein, 377 aa, Homo sapiens
MDEEPERTKRWEGGYERTWEILKEDESGSLKATIEDILFKAKRKRVFEHHGQVRLGMMRHLYVVVDGSRTMEDQDLKPNRLTCTLKLLEYFVEEYFDQNPISQIGIIVTKSKRAEKLTELSGNPRKHITSLKKAVDMTCHGEPSLYNSLSMAMQTLKHMPGHTSREVLIIFSSLTTCDPSNIYDLIKTLKAALARETGGTYHVILDESHYKELLTHHVSPPPASSSSECSLIRMGFPQHTIASLSDQDAKPSFSMAHLDGNTEPGLTLGGYFCPQCRAKYCELPVECKICGLTLVSAPHLARSYHHLFPLDAFQEIPLEEYNGERFCYGCQGELKDQHVYVCAVCQNVFCVDCDVFVHDSLHCCPGCIHKIPAPSGV

SEQ ID NO: 852136 - protein, 210 aa, Homo sapiens
MTCHGEPSLYNSLSMAMQTLKHMPGHTSREVLIIFSSLTTCDPSNIYDLIKTLKAAKIRVSVIGLSAEVRVCTVLARETGGTYHVILDESHYKELLTHHVSPPPASSSSECSLIRMGFPQHTIASLSDQDAKPSFSMAHLFPLDAFQEIPLEEYNGERFCYGCQGELKDQHVYVCAVCQNVFCVDCDVFVHDSLHCCPGCIHKIPAPSGV

SEQ ID NO: 852137 - protein, 165 aa, Homo sapiens; identical to SEQ ID NO: 852130

SEQ ID NO: 852138 - protein, 203 aa, Homo sapiens
MDEEPERTKRWEGGYERTWEILKEDESGSLKATIEDILFKAKRKRVFEHHGQVRLGMMRHLYVVVDGSRTMEDQDLKPNRLTCTLKLLEYFVEEYFDQNPISQIGIIVTKSKRAEKLTELSGNPRKHITSLKKAVDMTCHGEPSLYNSLSMAMQTLKHMPGHTSREVLIIFSSLTTCDPSNIYDLIKVDQKIKTKVITVKRIL

SEQ ID NO: 852139 - protein, 165 aa, Homo sapiens; identical to SEQ ID NO: 852130

SEQ ID NO: 852140 - protein, 395 aa, Homo sapiens [sequence omitted]

SEQ ID NO: 852141 - protein, 395 aa, Homo sapiens [sequence omitted]

SEQ ID NO: 852142 - protein, 203 aa, Homo sapiens; identical to SEQ ID NO: 852138

SEQ ID NO: 852143 - protein, 346 aa, Homo sapiens
MDEEPERTKRWEGGYERTWEILKEDESGSLKATIEDILFKAKRKRVFEHHGQVRLGMMRHLYVVVDGSRTMEDQDLKPNRLTCTLKLLEYFVEEYFDQNPISQIGIIVTKSKRAEKLTELSGNPRKHITSLKKAVDMTCHGEPSLYNSLSMAMQTLKHMPGHTSREVLIIFSSLTTCDPSNIYDLIKTLKAAKIRVSVIGLSAEVRVCTVLARETGGTYHVILDESHYKELLTHHVSPPPASSSSECSLIRMGFPQHTIASLSDQDAKPSFSMAHLFPLDAFQEIPLEEYNGERFCYGCQGELKDQHVYVCAVCQNVFCVDCDVFVHDSLHCCPGCIHKIPAPSGV

SEQ ID NO: 852144 - protein, 348 aa, Homo sapiens
MDEEPERTKRWEGGYERTWEILKEDESGSLKATIEDILFKAKRKRVFEHHGQVRLGMMRHLYVVVDGSRTMEDQDLKPNRLTCTLKLLEYFVEEYFDQNPISQIGIIVTKSKRAEKLTELSGNPRKHITSLKKAVDMTCHGEPSLYNSLSMAMQTLKHMPGHTSREVLIIFSSLTTCDPSNIYDLIKTLKAAKIRVSVIGLSAEVRVCTVLARETGGTYHVILDESHYKELLTHHVSPPPASSSSECSLIRMGFPQHTIASLSDQDAKPSFSMAHLDGNTEPGLTLGGYFCPQCRAKYCELPVECKICGLTLVSAPHLARSYHHLFPLDAFQEIPLEEYNGERYFSLD

SEQ ID NO: 852145 - protein, 165 aa, Homo sapiens; identical to SEQ ID NO: 852130

SEQ ID NO: 852146 - protein, 106 aa, Homo sapiens
MDEEPERTKRWEGGYERTWEILKEDESGSLKATIEDILFKAKRKRVFEHHGQVRLGMMRHLYVVVDGSRTMEDQDLKPNRLTCTLKVKFKFILNHLNLYQNHLNFY

SEQ ID NO: 852147 - protein, 97 aa, Homo sapiens
LSVSDFYYVAMDFGGHGLSSHYSPGVPYYLQTFVSEIRRVVAGKKQSVYFRRCGGCSRAPPLITGGGVGSRKQRWPESGAWALAPGLPAIHGRSWES

SEQ ID NO: 852148 - protein, 113 aa, Homo sapiens [sequence omitted]

SEQ ID NO: 852149 - protein, 351 aa, Homo sapiens
KNILARGWRTEAGARGEGGQPSRRAYNSPGLISELKLAVPWGHIAAKAWGSLQGPPVLCLHGWLDNASSFDRLIPLLPQDFYYVAMDFGGHGLSSHYSPGVPYYLQTFVSEIRRVVAALKWNRFSILGHSFGGVVGGMFFCTFPEMVDKLILLDTPLFLLESDEMENLLTYKRRAIEHVLQVEASQEPSHVFSLKQLLQRLLKSNSHLSEECGELLLQRGTTKVATGLVLNRDQRLAWAENSIDFISRELCAHSIRKLQAHVLLIKAVHGYFDSRQNYSEKESLSFMIDTMKSTLKEVRRGSGSWCPATVAHSGPTSPISSHALGRPWVCPQAQQVTTRIYQASCSTVVSP

SEQ ID NO: 852150 - protein, 43 aa, Homo sapiens
FYYVAMDFGGHGLSSHYSPGVPYYLQTFVSEIRRVVAGKKQSV

SEQ ID NO: 852151 - protein, 314 aa, Homo sapiens
MSENAAPGLISELKLAVPWGHIAAKAWGSLQGPPVLCLHGWLDNASSFDRLIPLLPQDFYYVAMDFGGHGLSSHYSPGVPYYLQTFVSEIRRVVAALKWNRFSILGHSFGGVVGGMFFCTFPEMVDKLILLDTPLFLLESDEMENLLTYKRRAIEHVLQVEASQEPSHVFSLKQLLQRLLKSNSHLSEECGELLLQRGTTKVATGLVLNRDQRLAWAENSIDFISRELCAHSIRKLQAHVLLIKAVHGYFDSRQNYSEKESLSFMIDTMKSTLKEQFQFVEVPGNHCVHMSEPQHVASIISSFLQCTHMLPAQL

SEQ ID NO: 852152 - protein, 209 aa, Homo sapiens
MSENAAPGLISELKLAVPWGHIAAKAWGSLQGPPVLCLHGWLDNASSFDRLIPLLPQDFYYVAMDFGGHGLSSHYSPGVPYYLQTFVSEIRRVVAALKWNRFSILGHSFGGVVGGMFFCTFPEMVDKLILLDTPLFLLESDEMENLLTYKRRAIEHVLQVEASQEPSHVFSLKQLLQRLLKSNSHLSEECGELLLQRGTTKVATGREQH

SEQ ID NO: 852153 - protein, 244 aa, Homo sapiens
MFRGTPGSPGKGGSVLSFFPLFILPFWHPHMFFCTFPEMVDKLILLDTPLFLLESDEMENLLTYKRRAIEHVLQVEASQEPSHVFSLKQLLQRLLKSNSHLSEECGELLLQRGTTKVATGLVLNRDQRLAWAENSIDFISRELCAHSIRKLQAHVLLIKAVHGYFDSRQNYSEKESLSFMIDTMKSTLKEVRRGSGSWCPATVAHSGPTSPISSHALGRPWVCPQAQQVTTRIYQASCSTVVSP

SEQ ID NO: 852154 - protein, 123 aa, Homo sapiens
MAVLPPQARGHRCVCGRSQPPSVGPRSPRSFHGEGQARRAQTMGDRLRQRSPEAPHTNLRPMGPLRGAGVVGPRRPGQESRPRGYAAAGSSSAPLRVLLTHSRAATRRTGRPRPIHTQPYLAF

SEQ ID NO: 852155 - protein, 625 aa, Homo sapiens
MAVLPPQARGHRCVCGRSQPPSVGPRSPRSFHGEGQARRAQTMGDRLRQRSPEAPHTNLRPMGPLRGAGVVGPRRPGQESRPRGYAAAGSSSAPLRVLLTHSRAATRRTGENPATASGRKRTCRDVRHFRGVAWRAWRPPLAACLVPCSASVRPSVPSAQPRQARSEQPTMGWGGGGGCTPRPPIHQQPPERRVVTVVFLGLLLDLLAFTLLLPLLPGLLESHGRAHDPLYGSWQGGVDWFATAIGMPVEKRYNSVLFGGLIGSAFSVLQFLCAPLTGATSDCLGRRPVMLLCLMGVATSYAVWATSRSFAAFLASRLIGGISKGNVSLSTAIVADLGSPLARSQGMAVIGVAFSLGFTLGPMLGASLPLEMAPWFALLFAASDLLFIFCFLPETLPLEKRAPSIALGFRDAADLLSPLALLRFSAVARGQDPPSGDRLSSLRRLGLVYFLYLFLFSGLEYTLSFLTHQRFQFSSLQQGKMFFLIGLTMATIQGAYARRIHPGGEVAAVKRALLLLVPAFLLIGWGRSLPVLGLGLLLYSFAAAVVVPCLSSVVAGYGSPGQKGTVMGTLRSLGALARAAGPLVAASVYWLAGAQACFTTWSGLFLLPFFLLQKLSYPAQTLKAE

SEQ ID NO: 852156 - protein, 536 aa, Homo sapiens
MAVLPPQARGHRCVCGRSQPPSVGPRSPRSFHGEGQARRAQTMGDRLRQRSPEAPHTNLRPMGPLRGAGVVGPRRPGQESRPRGYAAAGSSSAPLRVLLTHSRAATRRTGENPATASGRKRTCRDVRHFRGVAWRAWRPPLAACLVPCSASVRPSVPSAQPRQARSEQPTMGWGGGGGCTPRPPIHQQPPERRVVTVVFLGLLLDLLAFTLLLPLLPGLLESHGRAHDPLYGSWQGGVDWFATAIGMPVEKRYNSVLFGGLIGSAFSVLQFLCAPLTGATSDCLGRRPVMLLCLMGVATSYAVWATSRSFAAFLASRLIGGISKGNVSLSTAIVADLGSPLARSQGMAVIGVAFSLGFTLGPMLGASLPLEMAPWFALLFAASDLLFIFCFLPETLPLEKRAPSIALGFRDAADLLSPLALLRFSAVARGQDPPSGDRLSSLRRLGLVYFLYLFLFSGLEYTLSFLTHQRFQFSRPSCCWCPPSSSSAGDVLCPCWAWGCCSTPLPPPLWCPACPPWSLAMAHQGRRARSWVHCAA

SEQ ID NO: 852157 - protein, 598 aa, Homo sapiens
MAVLPPQARGHRCVCGRSQPPSVGPRSPRSFHGEGQARRAQTMGDRLRQRSPEAPHTNLRPMGPLRGAGVVGPRRPGQESRPRGYAAAGSSSAPLRVLLTHSRAATRRTGENPATASGRKRTCRDVRHFRGVAWRAWRPPLAACLVPCSASVRPSVPSAQPRQARSEQPTMGWGGGGGCTPRPPIHQQPPERRVVTVVFLGLLLDLLAFTLLLPLLPGLLESHGRAHDPLYGSWQGGVDWFATAIGMPVEKRYNSVLFGGLIGSAFSVLQFLCAPLTGATSDCLGRRPVMLLCLMGVATSYAVWATSRSFAAFLASRLIGGISKGNVSLSTAIVADLGSPLARSQGMAVIGVAFSLGFTLGPMLGASLPLEMAPWFALLFAASDLLFIFCFLPETLPLEKRAPSIALGFRDAADLLSPLALLRFSAVARGQDPPSGDRLSSLRRLGLVYFLYLFLFSGLEYTLSFLTHQRFQFSSLQQGKMFFLIGLTMATIQGAYARRIHPGGEVAAVKRALLLLVPAFLLIGWGRSLPVLGLGLLLYSFAAAVVVPCLSSVVAGYGSPGQKGTVMGTLRSLGALARAAGPLVAASEAELPGTDAQG

SEQ ID NO: 852158 - protein, 857 aa, Homo sapiens
MAKAKKVGARRKASGAPAGARGGPAKANSNPFEVKVNRQKFQILGRKTRHDVGLPGVSRARALRKRTQTLLKEYKERDKSNVFRDKRFGEYNSNMSPEEKMMKRFALEQQRHHEKKSIYNLNEDEELTHYGQSLADIEKHNDIVDSDSDAEDRGTLSAELTAAHFGGGGGLLHKKTQQEGEEREKPKSRKELIEELIAKSKQEKRERQAQREDALELTEKLDQDWKEIQTLLSHKTPKSENRDKKEKPKPDAYDMMVRELGFEMKAQPSNRMKTEAELAKEEQEHLRKLEAERLRRMLGKDEDENVKKPKHMSADDLNDGFVLDKDDRRLLSYKDGKMNVEEDVQEEQSKEASDPESNEEEGDSSGGEDTEESDSPDSHLDLESNVESEEENEKPAKEQRQTPGKGLISGKERAGKATRDELPYTFAAPESYEELRSLLLGRSMEEQLLVVERIQKCNHPSLAEGNKAKLEKLFGFLLEYVGDLATDDPPDLTVIDKLVVHLYHLCQMFPESASDAIKFVLRDAMHEMEEMIETKGRAALPGLDVLIYLKITGLLFPTSDFWHPVVTPALVCLSQLLTKCPILSLQDVVKGLFVCCLFLEYVALSQRFIPELINFLLGILYIATPNKASQGSTLVHPFRALGKNSELLVVSAREDVATWQQSSLSLRWASRLRAPTSTEANHIRLSCLAVGLALLKRCVLMYGSLPSFHAIMGPLQALLTDHLADCSHPQELQELCQSTLTEMESQKQLCRPLTCEKSKPVPLKLFTPRLVKVLEFGRKQGSSKEEQERKRLIHKHKREFKGAVREIRKDNQFLARMQLSEIMERDAERKRKVKQLFNSLATQEGEWKALKRKKFKK

SEQ ID NO: 852159 - protein, 857 aa, Homo sapiens; identical to SEQ ID NO: 852158

SEQ ID NO: 852160 - protein, 857 aa, Homo sapiens; identical to SEQ ID NO: 852158

SEQ ID NO: 852161 - protein, 857 aa, Homo sapiens; identical to SEQ ID NO: 852158

SEQ ID NO: 852162 - protein, 690 aa, Homo sapiens
MAVLPPQARGHRCVCGRSQPPSVGPRSPRSFHGEGQARRAQTMGDRLRQRSPEAPHTNLRPMGPLRGAGVVGPRRPGQESRPRGYAAAGSSSAPLRVLLTHSRAATRRTGENPATASGRKRTCRDVRHFRGVAWRAWRPPLAACLVPCSASVRPSVPSAQPRQARSEQPTMGWGGGGGCTPRPPIHQQPPERRVVTVVFLGLLLDLLAFTLLLPLLPGLLESHGRAHDPLYGSWQGGVDWFATAIGMPVEKRYNSVLFGGLIGSAFSVLQFLCAPLTGATSDCLGRRPVMLLCLMGVATSYAVWATSRSFAAFLASRLIGGISKGNVSLSTAIVADLGSPLARSQGMAVIGVAFSLGFTLGPMLGASLPLEMAPWFALLFAASDLLFIFCFLPETLPLEKRVGLWSGTHRPRGWRLDSIAMKVPLCASPRCQGGWAALLVLGPLRPQSVGCQASSRSCRLSNAIPQAPSIALGFRDAADLLSPLALLRFSAVARGQDPPSGDRLSSLRRLGLVYFLYLFLFSGLEYTLSFLTHQRFQFSSLQQGKMFFLIGLTMATIQGAYARRIHPGGEVAAVKRALLLLVPAFLLIGWGRSLPVLGLGLLLYSFAAAVVVPCLSSVVAGYGSPGQKGTVMGTLRSLGALARAAGPLVAASVYWLAGAQACFTTWSGLFLLPFFLLQKLSYPAQTLKAE

SEQ ID NO: 852163 - protein, 638 aa, Homo sapiens
MAVLPPQARGHRCVCGRSQPPSVGPRSPRSFHGEGQARRAQTMGDRLRQRSPEAPHTNLRPMGPLRGAGVVGPRRPGQESRPRGYAAAGSSSAPLRVLLTHSRAATRRTGENPATASGRKRTCRDVRHFRGVAWRAWRPPLAACLVPCSASVRPSVPSAQPRQARSEQPTMGWGGGGGCTPRPPIHQQPPERRVVTVVFLGLLLDLLAFTLLLPLLPGLLESHGRAHDPLYGSWQGGVDWFATAIGMPVEKRYNSVLFGGLIGSAFSVLQFLCAPLTGATSDCLGRRPVMLLCLRPPLPLGPLPLGKMGVATSYAVWATSRSFAAFLASRLIGGISKGNVSLSTAIVADLGSPLARSQGMAVIGVAFSLGFTLGPMLGASLPLEMAPWFALLFAASDLLFIFCFLPETLPLEKRAPSIALGFRDAADLLSPLALLRFSAVARGQDPPSGDRLSSLRRLGLVYFLYLFLFSGLEYTLSFLTHQRFQFSSLQQGKMFFLIGLTMATIQGAYARRIHPGGEVAAVKRALLLLVPAFLLIGWGRSLPVLGLGLLLYSFAAAVVVPCLSSVVAGYGSPGQKGTVMGTLRSLGALARAAGPLVAASVYWLAGAQACFTTWSGLFLLPFFLLQKLSYPAQTLKAE

SEQ ID NO: 852164 - protein, 660 aa, Homo sapiens
CLLFFPQRERQAQREDALELTEKLDQDWKEIQTLLSHKTPKSENRDKKEKPKPDAYDMMVRELGFEMKAQPSNRMKTEAELAKEEQEHLRKLEAERLRRMLGKDEDENVKKPKHMSADDLNDGFVLDKDDRRLLSYKDGKMNVEEDVQEEQSKEASDPESNEEEGDSSGGEDTEESDSPDSHLDLESNVESEEENEKPAKEQRQTPGKGLISGKERAGKATRDELPYTFAAPESYEELRSLLLGRSMEEQLLVVERIQKCNHPSLAEGNKAKLEKLFGFLLEYVGDLATDDPPDLTVIDKLVVHLYHLCQMFPESASDAIKFVLRDAMHEMEEMIETKGRAALPGLDVLIYLKITGLLFPTSDFWHPVVTPALVCLSQLLTKCPILSLQDVVKGLFVCCLFLEYVALSQRFIPELINFLLGILYIATPNKASQGSTLVHPFRALGKNSELLVVSAREDVATWQQSSLSLRWASRLRAPTSTEANHIRLSCLAVGLALLKRCVLMYGSLPSFHAIMGPLQALLTDHLADCSHPQELQELCQSTLTEMESQKQLCRPLTCEKSKPVPLKLFTPRLVKVLEFGRKQGSSKEEQERKRLIHKHKREFKGAVREIRKDNQFLARMQLSEIMERDAERKRKVKQLFNSLATQEGEWKALKRKKFKK

SEQ ID NO: 852165 - protein, 279 aa, Homo sapiens [sequence omitted]

SEQ ID NO: 852166 - protein, 844 aa, Homo sapiens
MAKAKKVGARRKASGAPAGARGGPAKANSNPFEVKVNRQKFQILGRKTRHDVGLPGVSRARALRKRTQTLLKEYKERDKSNVFRDKRFGEYNSNMSPEEKMMKRFALEQQRHHEKKSIYNLNEDEELTHYGQSLADIEKHNDIVDSDSDAEDRGTLSAELTAAHFGGGGGLLHKKTQQEGEEREKPKSRKELIEELIAKSKQEKRERQAQREDALELTEKLDQDWKEIQTLLSHKTPKSENRDKKEKPKPDAYDMMVRELGFEMKAQPSNRMKTEAELAKEEQEHLRKLEAERLRRMLGKDEDENVKKPKHMSADDLNDGFVLDKDDRRLLSYKDGKMNVEEDVQEEQSKEASDPESNEEEGDSSGGEDTEESDSPDSHLDLESNVESEEENEKPAKEQRQTPGKGLISGKERAGKATRDELPYTFAGRSMEEQLLVVERIQKCNHPSLAEGNKAKLEKLFGFLLEYVGDLATDDPPDLTVIDKLVVHLYHLCQMFPESASDAIKFVLRDAMHEMEEMIETKGRAALPGLDVLIYLKITGLLFPTSDFWHPVVTPALVCLSQLLTKCPILSLQDVVKGLFVCCLFLEYVALSQRFIPELINFLLGILYIATPNKASQGSTLVHPFRALGKNSELLVVSAREDVATWQQSSLSLRWASRLRAPTSTEANHIRLSCLAVGLALLKRCVLMYGSLPSFHAIMGPLQALLTDHLADCSHPQELQELCQSTLTEMESQKQLCRPLTCEKSKPVPLKLFTPRLVKVLEFGRKQGSSKEEQERKRLIHKHKREFKGAVREIRKDNQFLARMQLSEIMERDAERKRKVKQLFNSLATQEGEWKALKRKKFKK

SEQ ID NO: 852167 - protein, 810 aa, Homo sapiens
MAKAKKVGARRKASGAPAGARGGPAKANSNPFEVKVNRQKFQILGRKTRHDVGLPGVSRARALRKRTQTLLKEYKERDKSNVFRDKRFGEYNSNMSPEEKMMKRFALEQQRHHEKKSIYNLNEDEELTHYGQSLADIEKHNDIVDSDSDAEDRGTLSAELTAAHFGGGGGLLHKKTQQEGEEREKPKSRKELIEELIAKSKQEKRERQAQREDALELTEKLDQDWKEIQTLLSHKTPKSENRDKKEKPKPDAYDMMVRELGFEMKAQPSNRMKTEAELAKEEQEHLRKLEAERLRRMLGKDEDENVKKPKHMSADDLNDGFVLDKDDRRLLSYKDGKMNVEEDVQEEQSKEASDPESNEEEGDSSGGEDTEESDSPDSHLDLESNVESEEENEKPAKEQRQTPGKGLISGKERAGKATRDELPYTFAAPESYEELRSLLLGRSMEEQLLVVERIQKCNHPSLAEGNKAKLEKLFGFLLEYVGDLATDDPPDLTVIDKLVVHLYHLCQMFPESASDAIKFVLRDAMHEMEEMIETKGRAALPGLDVLIYLKITGLLFPTSDFWHPVVTPALVCLSQLLTKCPILSLQDVVKGLFVCCLFLEYVALSQRFIPELINFLLGILYIATPNKASQGSTLVHPFRALGKNSELLVVSAREDVATWQQSSLSLRWASRLRAPTSTEANHIRLSCLAVGLALLKRCVLMYGSLPSFHAIMGPLQALLTDHLADCSHPQELQELCQSTLTEMESQKQLCRPLTCEKSKPVPLKLFTPRLVKVLVSNSRPQVIHLPWPPNYRCEPQHPAKKVIFFRVIML

SEQ ID NO: 852168 - protein, 801 aa, Homo sapiens
MAKAKKVGARRKASGAPAGARGGPAKANSNPFEVKVNRQKFQILGRKTRHDVGLPGVSRARALRKRTQTLLKEYKERDKSNVFRDKRFGEYNSNMSPEEKMMKRFALEQQRHHEKKSIYNLNEDEELTHYGQSLADIEKHNDIVDSDSDAEDRGTLSAELTAAHFGGGGGLLHKKTQQEGEEREKPKSRKELIEELIAKSKQEKRERQAQREDALELTEKLDQDWKEIQTLLSHKTPKSENRDKKEKPKPDAYDMMVRELGFEMKAQPSNRMKTEAELAKEEQEHLRKLEAERLRRMLGKDEDENVKKPKHMSADDLNDGFVLDKDDRRLLSYKDGKMNVEEDVQEEQSKEASDPESNEEEGDSSGGEDTEESDSPDSHLDLESNVESEEENEKPAKEQRQTPGKGLISGKERAGKATRDELPYTFAAPESYEELRSLLLGRSMEEQLLVVERIQKCNHPSLAEGNKAKLEKLFGFLLEYVGDLATDDPPDLTVIDKLVVHLYHLCQMFPESASDAIKFVLRDAMHEMEEMIETKGRAALPGLDVLIYLKITGLLFPTSDFWHPVVTPALVCLSQLLTKCPILSLQDVVKGLFVCCLFLEYVALSQRFIPELINFLLGILYIATPNKASQGSTLVHPFRALGKNSELLVVSAREDVATWQQSSLSLRWASRLRAPTSTEANHIRLSCLAVGLALLKRCVLMYGSLPSFHAIMGPLQALLTDHLADCSHPQELQELCQSTLTEMESQKQLCRPLTCEKSKPVPLKLFTPRLVKVCGCWQHLPGRPGLWAQWELTGGVCQFCS

SEQ ID NO: 852169 - protein, 828 aa, Homo sapiens
MAKAKKVGARRKASGAPAGARGGPAKANSNPFEVKVNRQKFQILGRKTRHDVGLPGVSRARALRKRTQTLLKEYKERDKSNVFRDKRFGEYNSNMSPEEKMMKRFALEQQRHHEKKSIYNLNEDEELTHYGQSLADIEKHNDIVDSDSDAEDRGTLSAELTAAHFGGGGGLLHKKTQQEGEEREKPKSRKELIEELIAKSKQEKRERQAQREDALELTEKLDQDWKEIQTLLSHKTPKSENRDKKEKPKPDAYDMMVRELGFEMKAQPSNRMKTEAELAKEEQEHLRKLEAERLRRMLGKDEDENVKKPKHMSADDLNDGFVLDKDDRRLLSYKDGKMNVEEDVQEEQSKEASDPESNEEEGDSSGGEDTEESDSPDSHLDLESNVESEEENEKPAKEQRQTPGKGLISGKERAGKATRDELPYTFAAPESYEELRSLLLGRSMEEQLLVVERIQKCNHPSLAEGNKAKLEKLFGFLLEYVGDLATDDPPDLTVIDKLVVHLYHLCQMFPESASDAIKFVLRDAMHEMEEMIETKGRAALPGLDVLIYLKITGLLFPTSDFWHPVVTPALVCLSQLLTKCPILSLQDVVKGLFVCCLFLEYVALSQRFIPELINFLLGILYIATPNKASQGSTLVHPFRALGKNSELLVVSAREDVATWQQSSLSLRWASRLRAPTSTEANHIRLSCLAVGLALLKRCVLMYGSLPSFHAIMGPLQALLTDHLADCSHPQELQELCQSTLTEMESQKQLCRPLTCEKSKPVPLKLFTPRLVKVLEFGRKQGSSKEEQERKRLVSNSRPQVIHLPWPPNYRCEPQHPAKKVIFFRVIML

SEQ ID NO: 852170 - protein, 199 aa, Homo sapiens
MAVLPPQARGHRCVCGRSQPPSVGPRSPRSFHGEGQARRAQTMGDRLRQRSPEAPHTNLRPMGPLRGAGVVGPRRPGQESRPRGYAAAGSSSAPLRVLLTHSRAATRRTGENPATASRRVGRPTASGPTLSGSPGQKGTVMGTLRSLGALARAAGPLVAASVYWLAGAQACFTTWSGLFLLPFFLLQKLSYPAQTLKAE

SEQ ID NO: 852171 - protein, 115 aa, Homo sapiens [sequence omitted]

SEQ ID NO: 852172 - protein, 43 aa, Homo sapiens
MTSSQDSNPPYVPFQCPILSLQDVVKGLFVCCLFLEYVALSQR

SEQ ID NO: 852173 - protein, 106 aa, Homo sapiens [sequence omitted]

SEQ ID NO: 852174 - protein, 455 aa, Homo sapiens
MGWGGGGGCTPRPPIHQQPPERRVVTVVFLGLLLDLLAFTLLLPLLPGLLESHGRAHDPLYGSWQGGVDWFATAIGMPVEKRYNSVLFGGLIGSAFSVLQFLCAPLTGATSDCLGRRPVMLLCLMGVATSYAVWATSRSFAAFLASRLIGGISKGNVSLSTAIVADLGSPLARSQGMAVIGVAFSLGFTLGPMLGASLPLEMAPWFALLFAASDLLFIFCFLPETLPLEKRAPSIALGFRDAADLLSPLALLRFSAVARGQDPPSGDRLSSLRRLGLVYFLYLFLFSGLEYTLSFLTHQRFQFSSLQQGKMFFLIGLTMATIQGAYARRIHPGGEVAAVKRALLLLVPAFLLIGWGRSLPVLGLGLLLYSFAAAVVVPCLSSVVAGYGSPGQKGTVMGTLRSLGALARAAGPLVAASVYWLAGAQACFTTWSGLFLLPFFLLQKLSYPAQTLKAE

SEQ ID NO: 852175 - protein, 625 aa, Homo sapiens; identical to SEQ ID NO: 852155

SEQ ID NO: 852176 - protein, 650 aa, Homo sapiens
MAVLPPQARGHRCVCGRSQPPSVGPRSPRSFHGEGQARRAQTMGDRLRQRSPEAPHTNLRPMGPLRGAGVVGPRRPGQESRPRGYAAAGSSSAPLRVLLTHSRAATRRTGENPATASGRKRTCRDVRHFRGVAWRAWRPPLAACLVPCSASVRPSVPSAQPRQARSEQPTMGWGGGGGCTPRPPIHQQPPERRVVTVVFLGLLLDLLAFTLLLPLLPGLLESHGRAHDPLYGSWQGGVDWFATAIGMPVEKRYNSVLFGGLIGSAFSVLQFLCAPLTGATSDCLGRRPVMLLCLMGVATSYAVWATSRSFAAFLASRLIGGISKGNVSLSTAIVADLGSPLARSQGMAVIGVAFSLGFTLGPMLGASLPLEMAPWFALLFAASDLLFIFCFLPETLPLEKRAPSIALGFRDAADLLSPLALLRFSAVARGQDPPSGDRLSSLRRLGLVYFLYLFLFSGLEYTLSFLTHQRFQFSSLQQGKMFFLIGLTMATIQGAYARRIHPGGEVAAVKRALLLLVPAFLLIGWGRSLPVLGLGLLLYSFAAAVVVPCLSSVVAGYGSPGQKGTVMGTLRSLGALARAAGPLVAASGEGAGWCWGRLGAKHLPSPPKCQPPRGLGDATVSPQCTGWPGPRPASPRGPGSFCSPSSSCRS

SEQ ID NO: 852177 - protein, 857 aa, Homo sapiens; identical to SEQ ID NO: 852158

SEQ ID NO: 852178 - protein, 580 aa, Homo sapiens
MAVLPPQARGHRCVCGRSQPPSVGPRSPRSFHGEGQARRAQTMGDRLRQRSPEAPHTNLRPMGPLRGAGVVGPRRPGQESRPRGYAAAGSSSAPLRVLLTHSRAATRRTGENPATASGRKRTCRDVRHFRGVAWRAWRPPLAACLVPCSASVRPSVPSAQPRQARSEQPTMGWGGGGGCTPRPPIHQQPPERRVVTVVFLGLLLDLLAFTLLLPLLPGLLESHGRAHDPLYGSWQGGVDWFATAIGMPVEKRYNSVLFGGLIGSAFSVLQFLCAPLTGATSDCLGRRPVMLLCLMGVATSYAVWATSRSFAAFLASRLIGGISKGNVSLSTAIVADLGSPLARSQGMAVIGVAFSLGFTLGPMLGASLPLEMAPWFALLFAASDLLFIFCFLPETLPLEKRAPSIALGFRDAADLLSPLALLRFSAVARGQDPPSGDRLSSLRRLGLVYFLYLFLFSGLEYTLSFLTHQRFQFSSLQQGKMFFLIGLTMATIQGAYARRIHPGGEVAAVKRALLLLVPAFLLIGWGRSLPVLGLGLLLYSFGGGVVVPSVSVVVVWSQGEGRMVTGSSVGRPGPGRSKGK

SEQ ID NO: 852179 - protein, 857 aa, Homo sapiens; identical to SEQ ID NO: 852158

SEQ ID NO: 852180 - protein, 857 aa, Homo sapiens; identical to SEQ ID NO: 852158

SEQ ID NO: 852181 - protein, 741 aa, Homo sapiens
MAVLPPQARGHRCVCGRSQPPSVGPRSPRSFHGEGQARRAQTMGDRLRQRSPEAPHTNLRPMGPLRGAGVVGPRRPGQESRPRGYAAAGSSSAPLRVLLTHSRAATRRTGENPATASGRKRTCRDVRHFRGVAWRAWRPPLAACLVPCSASVRPSVPSAQPRQARSEQPTMGWGGGGGCTPRPPIHQQPPERRVVTVVFLGLLLDLLAFTLLLPLLPGLLESHGRAHDPLYGSWQGGVDWFATAIGMPVEKRYNSVLFGGLIGSAFSVLQFLCAPLTGATSDCLGRRPVMLLCLVCSWAWVPMGKPPPTQPVAPWGQVGRGRWLWAPHGHWLALIASWRGFSGDQWLLFQSQAFKELLLAPEEGTENASGPQMLRNRAGLRGVVWVAKPYSEPLLALSDRPCLLAPAPGQMGVATSYAVWATSRSFAAFLASRLIGGISKGNVSLSTAIVADLGSPLARSQGMAVIGVAFSLGFTLGPMLGASLPLEMAPWFALLFAASDLLFIFCFLPETLPLEKRAPSIALGFRDAADLLSPLALLRFSAVARGQDPPSGDRLSSLRRLGLVYFLYLFLFSGLEYTLSFLTHQRFQFSSLQQGKMFFLIGLTMATIQGAYARRIHPGGEVAAVKRALLLLVPAFLLIGWGRSLPVLGLGLLLYSFAAAVVVPCLSSVVAGYGSPGQKGTVMGTLRSLGALARAAGPLVAASVYWLAGAQACFTTWSGLFLLPFFLLQKLSYPAQTLKAE

SEQ ID NO: 852182 - protein, 279 aa, Homo sapiens [sequence omitted]

SEQ ID NO: 852183 - protein, 412 aa, Homo sapiens
MAVLPPQARGHRCVCGRSQPPSVGPRSPRSFHGEGQARRAQTMGDRLRQRSPEAPHTNLRPMGPLRGAGVVGPRRPGQESRPRGYAAAGSSSAPLRVLLTHSRAATRRTGENPATASGRKRTCRDVRHFRGVAWRAWRPPLAACLVPCSASVRPSVPSAQPRQARSEQPTMGWGGGGGCTPRPPIHQQPPERRVVTVVFLGLLLDLLAFTLLLPLLPGLLESHGRAHDPLYGSWQGGVDWFATAIGMPVEKRYNSVLFGGLIGSAFSVLQFLCAPLTGATSDCLGRRPVMLLCLMGVATSYAVWATSRSFAAFLASRLIGGISKGNVSLSTAIVADLGSPLARSQGMPPTCCSSSASCQRRCPWRNGRPLSPWGSVMRLICSAPWPCCASRLSLVARTHPLETGSAACAAWA

SEQ ID NO: 852184 - protein, 675 aa, Homo sapiens
MAKAKKVGARRKASGAPAGARGGPAKANSNPFEVKVNRQKFQILGRKTRHDVGLPGVSRARALRKRTQTLLKEYKERDKSNVFRDKRFGEYNSNMSPEEKMMKRFALEQQRHHEKKSIYNLNEDEELTHYGQSLADIEKHNDIVDSDSDAEDRGTLSAELTAAHFGGGGGLLHKKTQQEGEEREKPKSRKELIEELIAKSKQEKRERQAQREDALELTEKLDQDWKEIQTLLSHKTPKSENRDKKEKPKPDAYDMMVRELGFEMKAQPSNRMKTEAELAKEEQEHLRKLEAERLRRMLGKDEDENVKKPKHMSADDLNDGFVLDKDDRRLLSYKDGKMNVEEDVQEEQSKEASDPESNEEEGDSSGGEDTEESDSPDSHLDLESNVESEEENEKPAKEQRQTPGKGLISGKERAGKATRDELPYTFAAPESYEELRSLLLGRSMEEQLLVVERIQKCNHPSLAEGNKAKLEKLFGFLLEYVGDLATDDPPDLTVIDKLVVHLYHLCQMFPESASDAIKFVLRDAMHEMEEMIETKGRAALPGLDVLIYLKITGLLFPTSDFWHPVVTPALVCLSQLLTKCPILSLQDVVKGLFVCCLFLEYVALSQRFIPELINFLLGILYIATPNKASQGSTLVHPFRALGKNSELLVVSAREDVATWQQSSLSLRWSRIPDLR

SEQ ID NO: 852185 - protein, 663 aa, Homo sapiens
MAKAKKVGARRKASGAPAGARGGPAKANSNPFEVKVNRQKFQILGRKTRHDVGLPGVSRARALRKRTQTLLKEYKERDKSNVFRDKRFGEYNSNMSPEEKMMKRFALEQQRHHEKKSIYNLNEDEELTHYGQSLADIEKHNDIVDSDSDAEDRGTLSAELTAAHFGGGGGLLHKKTQQEGEEREKPKSRKELIEELIAKSKQEKRERQAQREDALELTEKLDQDWKEIQTLLSHKTPKSENRDKKEKPKPDAYDMMVRELGFEMKAQPSNRMKTEAELAKEEQEHLRKLEAERLRRMLGKDEDENVKKPKHMSADDLNDGFVLDKDDRRLLSYKDGKMNVEEDVQEEQSKEASDPESNEEEGDSSGGEDTEESDSPDSHLDLESNVESEEENEKPAKEQRQTPGKGLISGKERAGKATRDELPYTFAAPESYEELRSLLLGRSMEEQLLVVERIQKCNHPSLAEGNKAKLEKLFGFLLEYVGDLATDDPPDLTVIDKLVVHLYHLCQMFPESASDAIKFVLRDAMHEMEEMIETKGRAALPGLDVLIYLKITGLLFPTSDFWHPVVTPALVCLSQLLTKCPILSLQDVVKGLFVCCLFLEYVALSQRFIPELINFLLGILYIATPNKASQERLGRTRNCSWCLLERMWPRGSRAASPSAGRVD

SEQ ID NO: 852186 - protein, 523 aa, Homo sapiens
MAKAKKVGARRKASGAPAGARGGPAKANSNPFEVKVNRQKFQILGRKTRHDVGLPGVSRARALRKRTQTLLKEYKERDKSNVFRDKRFGEYNSNMSPEEKMMKRFALEQQRHHEKKSIYNLNEDEELTHYGQSLADIEKHNDIVDSDSDAEDRGTLSAELTAAHFGGGGGLLHKKTQQEGEEREKPKSRKELIEELIAKSKQEKRERQAQREDALELTEKLDQDWKEIQTLLSHKTPKSENRDKKEKPKPDAYDMMVRELGFEMKAQPSNRMKTEAELAKEEQEHLRKLEAERLRRMLGKDEDENVKKPKHMSADDLNDGFVLDKDDRRLLSYKDGKMNVEEDVQEEQSKEASDPESNEEEGDSSGGEDTEESDSPDSHLDLESNVESEEENEKPAKEQRQTPGKGLISGKERAGKATRDELPYTFAAPESYEELRSLLLGRSMEEQLLVVERIQKCNHPSLAEGNKAKLEKLFGFLLEYVGDLATDDPPDLTVIDKLVVCFLNLQVTLSNLFSEMRCMRWKK

SEQ ID NO: 852187 - protein, 297 aa, Homo sapiens
AILSLQDGALGEQLTEATKCPILSLQDVVKGLFVCCLFLEYVALSQRFIPELINFLLGILYIATPNKASQGSTLVHPFRALGKNSELLVVSAREDVATWQQSSLSLRWASRLRAPTSTEANHIRLSCLAVGLALLKRCVLMYGSLPSFHAIMGPLQALLTDHLADCSHPQELQELCQSTLTEMESQKQLCRPLTCEKSKPVPLKLFTPRLVKVLEFGRKQGSSKEEQERKRLIHKHKREFKGAVREIRKDNQFLARMQLSEIMERDAERKRKVKQLFNSLATQEGEWKALKRKKFKK

SEQ ID NO: 852188 - protein, 116 aa, Homo sapiens
TFLAVRSTGYGDLQLPKSPPFRECSQGPAHGPPSSRRQWLYFVPAVPGLEQPQPWLTPPPTGRRTARAPSCCRELAALSSRCLDTTEPVRGAQGTQQVSHRRVGDFVFFRSCVRAH

SEQ ID NO: 852189 - protein, 75 aa, Homo sapiens
KQMLQGSCSKPRPHTEEKVLGLDSKRSKTGTGTKKRQVKLGEGKQETCTKATAEGAVTGQCISQVSFHELRKTSV

SEQ ID NO: 852190 - protein, 1287 aa, Homo sapiens
RDSCCAEEPCGTRGCARARALWPRRGDSEAHWGLPARGRPRRPARGLRLCAPSPEEDACRHRARAAGLNACLPGAAAALPSAGVGSGTRRAPGGRRAQAGYTLPESAEFAASEGGPAGPDGRGVCGPRRVLRSGPGTGGTLSAGAAAAERTWGGGHAPVRSLEPSGAPRGPARVCGRSGPHSPRARSSQRAPDKMARPVRGGLGAPRRSPCLLLLWLLLLRLEPVTAAAGPRAPCAAACTCAGDSLDCGGRGLAALPGDLPSWTRSLNLSYNKLSEIDPAGFEDLPNLQEVYLNNNELTAVPSLGAASSHVVSLFLQHNKIRSVEGSQLKAYLSLEVLDLSLNNITEVRNTCFPHGPPIKELNLAGNRIGTLELGAFDGLSRSLLTLRLSKNRITQLPVRAFKLPRLTQLDLNRNRIRLIEGLTFQGLNSLEVLKLQRNNISKLTDGAFWGLSKMHVLHLEYNSLVEVNSGSLYGLTALHQLHLSNNSIARIHRKGWSFCQKLHELVLSFNNLTRLDEESLAELSSLSVLRLSHNSISHIAEGAFKGLRSLRVLDLDHNEISGTIEDTSGAFSGLDSLSKLTLFGNKIKSVAKRAFSGLEGLEHLNLGGNAIRSVQFDAFVKMKNLKELHISSDSFLCDCQLKWLPPWLIGRMLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAARERRMHVMPDDDVFFITDVKIDDAGVYSCTAQNSAGSISANATLTVLETPSLVVPLEDRVVSVGETVALQCKATGNPPPRITWFKGDRPLSLTERHHLTPDNQLLVVQNVVAEDAGRYTCEMSNTLGTERAHSQLSVLPAAGCRKDGTTVGIFTIAVVSSIVLTSLVWVCIIYQTRKKSEEYSVTNTDETVVPPDVPSYLSSQGTLSDRQETVVRTEGGPQANGHIESNGVCPRDASHFPEPDTHSVACRQPKLCAGSAYHKEPWKAMEKAEGTPGPHKMEHGGRVVCSDCNTEVDCYSRGQAFHPQPVSRDSAQPSAPNGPEPGGSDQEHSPHHQCSRTAAGSCPECQGSLYPSNHDRMLTAVKKKPMASLDGKGDSSWTLARLYHPDSTELQPASSLTSGSPERAEAQYLLVSNGHLPKACDASPESTPLTGQLPGKQRVPLLLAPKS

SEQ ID NO: 852191 - protein, 1262 aa, Homo sapiens
RDSCCAEEPCGTRGCARARALWPRRGDSEAHWGLPARGRPRRPARGLRLCAPSPEEDACRHRARAAGLNACLPGAAAALPSAGVGSGTRRAPGGRRAQAGYTLPESAEFAASEGGPAGPDGRGVCGPRRVLRSGPGTGGTLSAGAAAAERTWGGGHAPVRSLEPSGAPRGPARVCGRSGPHSPRARSSQRAPDKMARPVRGGLGAPRRSPCLLLLWLLLLRLEPVTAAAGPRAPCAAACTCAGDSLDCGGRGLAALPGDLPSWTRSLNLSYNKLSEIDPAGFEDLPNLQEVQHNKIRSVEGSQLKAYLSLEVLDLSLNNITEVRNTCFPHGPPIKELNLAGNRIGTLELGAFDGLSRSLLTLRLSKNRITQLPVRAFKLPRLTQLDLNRNRIRLIEGLTFQGLNSLEVLKLQRNNISKLTDGAFWGLSKMHVLHLEYNSLVEVNSGSLYGLTALHQLHLSNNSIARIHRKGWSFCQKLHELVLSFNNLTRLDEESLAELSSLSVLRLSHNSISHIAEGAFKGLRSLRVLDLDHNEISGTIEDTSGAFSGLDSLSKLTLFGNKIKSVAKRAFSGLEGLEHLNLGGNAIRSVQFDAFVKMKNLKELHISSDSFLCDCQLKWLPPWLIGRMLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAARERRMHVMPDDDVFFITDVKIDDAGVYSCTAQNSAGSISANATLTVLETPSLVVPLEDRVVSVGETVALQCKATGNPPPRITWFKGDRPLSLTERHHLTPDNQLLVVQNVVAEDAGRYTCEMSNTLGTERAHSQLSVLPAAGCRKDGTTVGIFTIAVVSSIVLTSLVWVCIIYQTRKKSEEYSVTNTDETVVPPDVPSYLSSQGTLSDRQETVVRTEGGPQANGHIESNGVCPRDASHFPEPDTHSVACRQPKLCAGSAYHKEPWKAMEKAEGTPGPHKMEHGGRVVCSDCNTEVDCYSRGQAFHPQPVSRDSAQPSAPNGPEPGGSDQEHSPHHQCSRTAAGSCPECQGSLYPSNHDRMLTAVKKKPMASLDGKGDSSWTLARLYHPDSTELQPASSLTSGSPERAEAQYLLVSNGHLPKACDASPESTPLTGQLPGKQRVPLLLAPKS

SEQ ID NO: 852192 - protein, 1287 aa, Homo sapiens; identical to SEQ ID NO: 852190

SEQ ID NO: 852193 - protein, 843 aa, Homo sapiens
NSSRQWLIGRGYPNLSYNKLSEIDPAGFEDLPNLQEVYLNNNELTAVPSLGAASSHVVSLFLVLSFNNLTRLDEESLAELSSLSVLRLSHNSISHIAEGAFKGLRSLRVLDLDHNEISGTIEDTSGAFSGLDSLSKLTLFGNKIKSVAKRAFSGLEGLEHLNLGGNAIRSVQFDAFVKMKNLKELHISSDSFLCDCQLKWLPPWLIGRMLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAARERRMHVMPDDDVFFITDVKIDDAGVYSCTAQNSAGSISANATLTVLETPSLVVPLEDRVVSVGETVALQCKATGNPPPRITWFKGDRPLSLTERHHLTPDNQLLVVQNVVAEDAGRYTCEMSNTLGTERAHSQLSVLPAAGCRKDGTTVGIFTIAVVSSIVLTSLVWVCIIYQTRKKSEEYSVTNTDETVVPPDVPSYLSSQGTLSDRQETVVRTEGGPQANGHIESNGVCPRDASHFPEPDTHSVACRQPKLCAGSAYHKEPWKAMEKAEGTPGPHKMEHGGRVVCSDCNTEVDCYSRGQAFHPQPVSRDSAQPSAPNGPEPGGSDQEHSPHHQCSRTAAGSCPECQGSLYPSNHDRMLTAVKKKPMASLDGKGDSSWTLARLYHPDSTELQPASSLTSGSPERAEAQYLLVSNGHLPKACDASPESTPLTGQLPGKQRVPLLLAPKS

SEQ ID NO: 852194 - protein, 589 aa, Homo sapiens
MAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAARERRMHVMPDDDVFFITDVKIDDAGVYSCTAQNSAGSISANATLTVLETPSLVVPLEDRVVSVGETVALQCKATGNPPPRITWFKGDRPLSLTERHHLTPDNQLLVVQNVVAEDAGRYTCEMSNTLGTERAHSQLSVLPAAGCRKDGTTVGIFTIAVVSSIVLTSLVWVCIIYQTRKKSEEYSVTNTDETVVPPDVPSYLSSQGTLSDRQETVVRTEGGPQANGHIESNGVCPRDASHFPEPDTHSVACRQPKLCAGSAYHKEPWKAMEKAEGTPGPHKMEHGGRVVCSDCNTEVDCYSRGQAFHPQPVSRDSAQPSAPNGPEPGGSDQEHSPHHQCSRTAAGSCPECQGSLYPSNHDRMLTAVKKKPMASLDGKGDSSWTLARLYHPDSTELQPASSLTSGSPERAEAQYLLVSNGHLPKACDASPESTPLTGQLPGKQRVPLLLAPKS

SEQ ID NO: 852195 - protein, 479 aa, Homo sapiens
MARLECAATGHPNPQIAWQKDGGTDFPAARERRMHVMPDDDVFFITDVKIDDAGVYSCTAQNSAGSISANATLTVLETPSLVVPLEDRVVSVGETVALQCKATGNPPPRITWFKGDRPLSLTERHHLTPDNQLLVVQNVVAEDAGRYTCEMSNTLGTERAHSQLSVLPAAGCRKDGTTVGIFTIAVVSSIVLTSLVWVCIIYQTRKKSEEYSVTNTDETVVPPDVPSYLSSQGTLSDRQETVVRTEGGPQANGHIESNGVCPRDASHFPEPDTHSVACRQPKLCAGSAYHKEPWKAMEKAEGTPGPHKMEHGGRVVCSDCNTEVDCYSRGQAFHPQPVSRDSAQPSAPNGPEPGGSDQEHSPHHQCSRTAAGSCPECQGSLYPSNHDRMLTAVKKKPMASLDGKGDSSWTLARLYHPDSTELQPASSLTSGSPERAEAQYLLVSNGHLPKACDASPESTPLTGQLPGKQRVPLLLAPKS

SEQ ID NO: 852196 - protein, 883 aa, Homo sapiens
RDSCCAEEPCGTRGCARARALWPRRGDSEAHWGLPARGRPRRPARGLRLCAPSPEEDACRHRARAAGLNACLPGAAAALPSAGVGSGTRRAPGGRRAQAGYTLPESAEFAASEGGPAGPDGRGVCGPRRVLRSGPGTGGTLSAGAAAAERTWGGGHAPVRSLEPSGAPRGPARVCGRSGPHSPRARSSQRAPDKMARPVRGGLGAPRRSPCLLLLWLLLLRLEPVTAAAGPRAPCAAACTCAGDSLDCGGRGLAALPGDLPSWTRSLNLSYNKLSEIDPAGFEDLPNLQEVYLNNNELTAVPSLGAASSHVVSLFLQHNKIRSVEGSQLKAYLSLEVLDLSLNNITEVRNTCFPHGPPIKELNLAGNRIGTLELGAFDGLSRSLLTLRLSKNRITQLPVRAFKLPRLTQLDLNRNRIRLIEGLTFQGLNSLEVLKLQRNNISKLTDGAFWGLSKMHVLHLEYNSLVEVNSGSLYGLTALHQLHLSNNSIARIHRKGWSFCQKLHELVLSFNNLTRLDEESLAELSSLSVLRLSHNSISHIAEGAFKGLRSLRVLDLDHNEISGTIEDTSGAFSGLDSLSKLTLFGNKIKSVAKRAFSGLEGLEHLNLGGNAIRSVQFDAFVKMKNLKELHISSDSFLCDCQLKWLPPWLIGRMLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAARERRMHVMPDDRTAPRETEGATAVGTKKLGFVYLSSCHTNLYGKER

SEQ ID NO: 852197 - protein, 1287 aa, Homo sapiens; identical to SEQ ID NO: 852190

SEQ ID NO: 852198 - protein, 605 aa, Homo sapiens
RDSCCAEEPCGTRGCARARALWPRRGDSEAHWGLPARGRPRRPARGLRLCAPSPEEDACRHRARAAGLNACLPGAAAALPSAGVGSGTRRAPGGRRAQAGYTLPESAEFAASEGGPAGPDGRGVCGPRRVLRSGPGTGGTLSAGAAAAERTWGGGHAPVRSLEPSGAPRGPARVCGRSGPHSPRARSSQRAPDKMARPVRGGLGAPRRSPCLLLLWLLLLRLEPVTAAAGPRAPCAAACTCAGDSLDCGGRGLAALPGDLPSWTRSLNLSYNKLSEIDPAGFEDLPNLQEVYLNNNELTAVPSLGAASSHVVSLFLQHNKIRSVEGSQLKAYLSLEVLDLSLNNITEVRNTCFPHGPPIKELNLAGNRIGTLELGAFDGLSRSLLTLRLSKNRITQLPVRAFKLPRLTQLDLNRNRIRLIEGLTFQGLNSLEVLKLQRNNISKLTDGAFWGLSKMHVLHLEYNSLVEVNSGSLYGLTALHQLHLSNNSIARIHRKGWSFCQKLHELVLSFNNLTRLDEESLAELSSLSVLRLSHNSISHIAEGAFKGLRSLRVLDLDHNEISGTIEDTSGAFSGLDSLSKLTLFGNKIKSVAKRAFSGLEGLEHL

SEQ ID NO: 852199 - protein, 68 aa, Homo sapiens
MAMVGKDIRFTCSAASSSSSPKNHLVEIPTKLPSSLVELRIHGDRDPRGSRCPSDMVQGDSKYCRASR

SEQ ID NO: 852200 - protein, 1390 aa, Homo sapiens
RDSCCAEEPCGTRGCARARALWPRRGDSEAHWGLPARGRPRRPARGLRLCAPSPEEDACRHRARAAGLNACLPGAAAALPSAGVGSGTRRAPGGRRAQAGYTLPESAEFAASEGGPAGPDGRGVCGPRRVLRSGPGTGGTLSAGAAAAERTWGGGHAPVRSLEPSGAPRGPARVCGRSGPHSPRARSSQRAPDKMARPVRGGLGAPRRSPCLLLLWLLLLRLEPVTAAAGPRAPCAAACTCAGDSLDCGGRGLAALPGDLPSWTRSLLSAALSALSAPRGSVTWGWSGGGSYSGRGCGLGCVCGVVRACACWKTVRLEWRKGDSAWRSGGVGVRESLEKKSVPRGVWRRASVGRRDLGVSQHASCVAIWGNLSYNKLSEIDPAGFEDLPNLQEVYLNNNELTAVPSLGAASSHVVSLFLQHNKIRSVEGSQLKAYLSLEVLDLSLNNITEVRNTCFPHGPPIKELNLAGNRIGTLELGAFDGLSRSLLTLRLSKNRITQLPVRAFKLPRLTQLDLNRNRIRLIEGLTFQGLNSLEVLKLQRNNISKLTDGAFWGLSKMHVLHLEYNSLVEVNSGSLYGLTALHQLHLSNNSIARIHRKGWSFCQKLHELVLSFNNLTRLDEESLAELSSLSVLRLSHNSISHIAEGAFKGLRSLRVLDLDHNEISGTIEDTSGAFSGLDSLSKLTLFGNKIKSVAKRAFSGLEGLEHLNLGGNAIRSVQFDAFVKMKNLKELHISSDSFLCDCQLKWLPPWLIGRMLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAARERRMHVMPDDDVFFITDVKIDDAGVYSCTAQNSAGSISANATLTVLETPSLVVPLEDRVVSVGETVALQCKATGNPPPRITWFKGDRPLSLTERHHLTPDNQLLVVQNVVAEDAGRYTCEMSNTLGTERAHSQLSVLPAAGCRKDGTTVGIFTIAVVSSIVLTSLVWVCIIYQTRKKSEEYSVTNTDETVVPPDVPSYLSSQGTLSDRQETVVRTEGGPQANGHIESNGVCPRDASHFPEPDTHSVACRQPKLCAGSAYHKEPWKAMEKAEGTPGPHKMEHGGRVVCSDCNTEVDCYSRGQAFHPQPVSRDSAQPSAPNGPEPGGSDQEHSPHHQCSRTAAGSCPECQGSLYPSNHDRMLTAVKKKPMASLDGKGDSSWTLARLYHPDSTELQPASSLTSGSPERAEAQYLLVSNGHLPKACDASPESTPLTGQLPGKQRVPLLLAPKS

SEQ ID NO: 852201 - protein, 635 aa, Homo sapiens
MLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAARERRMHVMPDDDVFFITDVKIDDAGVYSCTAQNSAGSISANATLTVLETPSLVVPLEDRVVSVGETVALQCKATGNPPPRITWFKGDRPLSLTERHHLTPDNQLLVVQNVVAEDAGRYTCEMSNTLGTERAHSQLSVLPAAGCRKDGTTVGIFTIAVVSSIVLTSLVWVCIIYQTRKKSEEYSVTNTDETVVPPDVPSYLSSQGTLSDRQETVVRTEGGPQANGHIESNGVCPRDASHFPEPDTHSVACRQPKLCAGSAYHKEPWKAMEKAEGTPGPHKMEHGGRVVCSDCNTEVDCYSRGQAFHPQPVSRDSAQPSAPNGPEPGGSDQEHSPHHQCSRTAAGSCPECQGSLYPSNHDRMLTAVKKKPMASLDGKGDSSWTLARLYHPDSTELQPASSLTSGSPERAEAQYLLVSNGHLPKACDASPESTPLTGQLPGKQRVPLLLAPKS

SEQ ID NO: 852202 - protein, 427 aa, Homo sapiens
MYEGWFESGRGSAVLFQLMHPDCLETPSLVVPLEDRVVSVGETVALQCKATGNPPPRITWFKGDRPLSLTERHHLTPDNQLLVVQNVVAEDAGRYTCEMSNTLGTERAHSQLSVLPAAGCRKDGTTVGIFTIAVVSSIVLTSLVWVCIIYQTRKKSEEYSVTNTDETVVPPDVPSYLSSQGTLSDRQETVVRTEGGPQANGHIESNGVCPRDASHFPEPDTHSVACRQPKLCAGSAYHKEPWKAMEKAEGTPGPHKMEHGGRVVCSDCNTEVDCYSRGQAFHPQPVSRDSAQPSAPNGPEPGGSDQEHSPHHQCSRTAAGSCPECQGSLYPSNHDRMLTAVKKKPMASLDGKGDSSWTLARLYHPDSTELQPASSLTSGSPERAEAQYLLVSNGHLPKACDASPESTPLTGQLPGKQRVPLLLAPKS

SEQ ID NO: 852203 - protein, 1287 aa, Homo sapiens; identical to SEQ ID NO: 852190

SEQ ID NO: 852204 - protein, 920 aa, Homo sapiens
RDSCCAEEPCGTRGCARARALWPRRGDSEAHWGLPARGRPRRPARGLRLCAPSPEEDACRHRARAAGLNACLPGAAAALPSAGVGSGTRRAPGGRRAQAGYTLPESAEFAASEGGPAGPDGRGVCGPRRVLRSGPGTGGTLSAGAAAAERTWGGGHAPVRSLEPSGAPRGPARVCGRSGPHSPRARSSQRAPDKMARPVRGGLGAPRRSPCLLLLWLLLLRLEPVTAAAGPRAPCAAACTCAGDSLDCGGRGLAALPGDLPSWTRSLNLSYNKLSEIDPAGFEDLPNLQEVYLNNNELTAVPSLGAASSHVVSLFLQHNKIRSVEGSQLKAYLSLEVLDLSLNNITEVRNTCFPHGPPIKELNLAGNRIGTLELGAFDGLSRSLLTLRLSKNRITQLPVRAFKLPRLTQLDLNRNRIRLIEGLTFQGLNSLEVLKLQRNNISKLTDGAFWGLSKMHVLHLEYNSLVEVNSGSLYGLTALHQLHLSNNSIARIHRKGWSFCQKLHELVLSFNNLTRLDEESLAELSSLSVLRLSHNSISHIAEGAFKGLRSLRVLDLDHNEISGTIEDTSGAFSGLDSLSKLTLFGNKIKSVAKRAFSGLEGLEHLNLGGNAIRSVQFDAFVKMKNLKELHISSDSFLCDCQLKWLPPWLIGRMLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAARERRMHVMPDDDVFFITDVKIDDAGVYSCTAQNSAGSISANATLTVLETPSLVVPLEDRVVSVGETVALQCKATGNPPPRSPQ

SEQ ID NO: 852205 - protein, 872 aa, Homo sapiens
RDSCCAEEPCGTRGCARARALWPRRGDSEAHWGLPARGRPRRPARGLRLCAPSPEEDACRHRARAAGLNACLPGAAAALPSAGVGSGTRRAPGGRRAQAGYTLPESAEFAASEGGPAGPDGRGVCGPRRVLRSGPGTGGTLSAGAAAAERTWGGGHAPVRSLEPSGAPRGPARVCGRSGPHSPRARSSQRAPDKMARPVRGGLGAPRRSPCLLLLWLLLLRLEPVTAAAGPRAPCAAACTCAGDSLDCGGRGLAALPGDLPSWTRSLNLSYNKLSEIDPAGFEDLPNLQEVYLNNNELTAVPSLGAASSHVVSLFLQHNKIRSVEGSQLKAYLSLEVLDLSLNNITEVRNTCFPHGPPIKELNLAGNRIGTLELGAFDGLSRSLLTLRLSKNRITQLPVRAFKLPRLTQLDLNRNRIRLIEGLTFQGLNSLEVLKLQRNNISKLTDGAFWGLSKMHVLHLEYNSLVEVNSGSLYGLTALHQLHLSNNSIARIHRKGWSFCQKLHELVLSFNNLTRLDEESLAELSSLSVLRLSHNSISHIAEGAFKGLRSLRVLDLDHNEISGTIEDTSGAFSGLDSLSKLTLFGNKIKSVAKRAFSGLEGLEHLNLGGNAIRSVQFDAFVKMKNLKELHISSDSFLCDCQLKWLPPWLIGRMLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAARERRMHVMPDDDVFFITDVKIDDAGGYYWVNCRWY

SEQ ID NO: 852206 - protein, 878 aa, Homo sapiens
SGLLGRQALARRAVQAEKMAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFLPKIFIKPNAQKPLPQALSKERRERPQDRPEDLDVPPALADFIHQQRTQQVEQDMFAHPYQYELNHFTPADAVLQKPQPQLYRPIEETPCHFISSLDELVELNEKLLNCQEFAVDLEHHSYRSFLGLTCLMQISTRTEDFIIDTLELRSDMYILNESLTDPAIVKVFHGADSDIEWLQKDFGLYVVNMFDTHQAARLLNLGRHSLDHLLKLYCNVDSNKQYQLADWRIRPLPEEMLSYARDDTHYLLYIYDKMRLEMWERGNGQPVQLQVVWQRSRDICLKKFIKPIFTDESYLELYRKQKKHLNTQQLTAFQLLFAWRDKTARREDESYGYVLPNHMMLKIAEELPKEPQGIIACCNPVPPLVRQQINEMHLLIQQAREMPLLKSEVAAGVKKSGPLPSAERLENVLFGPHDCSHAPPDGYPIIPTSGSVPVQKQASLFPDEKEDNLLGTTCLIATAVITLFNEPSAEDSKKGPLTVAQKKAQNIMESFENPFRMISNRWKLAQVQVQKDSKEAVKKKAAEQTAAREQAKEACKAAAEQAISVRQQVVLENAAKKRERATSDPRTTEQKQEKKRLKISKKPKDPEPPEKEFTPYDYSQSDFKAFAGNSKSKVSSQFDPNKQTPSGKKCIAAKKIKQSVGNKSMSFPTGKSDRGFRYNWPQR

SEQ ID NO: 852207 - protein, 703 aa, Homo sapiens
SGLLGRQALARRAVQAEKMAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFLPKIFIKPNAQKPLPQALSKERRERPQDRPEDLDVPPALADFIHQQRTQQVEQDMFAHPYQYELNHFTPADAVLQKPQPQLYRPIEETPCHFISSLDELVELNEKLLNCQEFAVDLEHHSYRSFLGLTCLMQISTRTEDFIIDTLELRSDMYILNESLTDPAIVKVFHGADSDIEWLQKDFGLYVVNMFDTHQAARLLNLGRHSLDHLLKLYCNVDSNKQYQLADWRIRPLPEEMLSYARDDTHYLLYIYDKMRLEMWERGNGQPVQLQVVWQRSRDICLKKFIKPIFTDESYLELYRKQKKHLNTQQLTAFQLLFAWRDKTARREDESYGYVLPNHMMLKIAEELPKEPQGIIACCNPVPPLVRQQINEMHLLIQQAREMPLLKSEVAAGVKKSGPLPSAERLENVLFGPHDCSHAPPDGYPIIPTSGKVESPPDCPEEVGTQLPCLKFCRLGRAWWLMPVMPAYWKAEAGRSPEVRSLRPAWPTW

SEQ ID NO: 852208 - protein, 547 aa, Homo sapiens
SGLLGRQALARRAVQAEKMAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFLPKIFIKPNAQKPLPQALSKERRERPQDRPEDLDVPPALADFIHQQRTQQVEQDMFAHPYQYELNHFTPADAVLQKPQPQLYRPIEETPCHFISSLDELVELNEKLLNCQEFAVDLEHHSYRSFLGLTCLMQISTRTEDFIIDTLELRSDMYILNESLTDPAIVKVFHGADSDIEWLQKDFGLYVVNMFDTHQAARLLNLGRHSLDHLLKLYCNVDSNKQYQLADWRIRPLPEEMLSYARDDTHYLLYIYDKMRLEMWERGNGQPVQLQVVWQRSRDICLKKFIKPIFTDESYLELYRKQKKHLNTQQLTAFQLLFAWRDKTARREDESYG

SEQ ID NO: 852209 - protein, 903 aa, Homo sapiens
SGLLGRQALARRAVQAEKMAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFLPKIFIKPNAQKPLPQALSKERRERPQDRPEDLDVPPALADFIHQQRTQQVEQDMFAHPYQYELNHFTPADAVLQKPQPQLYRPIEETPCHFISSLDELVELNEKLLNCQEFAVDLEHHSYRSFLGLTCLMQISTRTEDFIIDTLELRSDMYILNESLTDPAIVKVFHGADSDIEWLQKDFGLYVVNMFDTHQAARLLNLGRHSLDHLLKLYCNVDSNKQYQLADWRIRPLPEEMLSYARDDTHYLLYIYDKMRLEMWERGNGQPVQLQVVWQRSRDICLKKFIKPIFTDESYLELYRKQKKHLNTQQLTAFQLLFAWRDKTARREDESYGYVLPNHMMLKIAEELPKEPQGIIACCNPVPPLVRQQINEMHLLIQQAREMPLLKSEVAAGVKKSGPLPSAERLENVLFGPHDCSHAPPDGYPIIPTSGSVPVQKQASLFPDEKEDNLLGTTCLIATAVITLFNEPSAEDSKKGPLTVAQKKAQNIMESFENPFRMFLPSLGHRAPVSQAAKFDPSTKIYEISNRWKLAQVQVQKDSKEAVKKKAAEQTAAREQAKEACKAAAEQAISVRQQVVLENAAKKRERATSDPRTTEQKQEKKRLKISKKPKDPEPPEKEFTPYDYSQSDFKAFAGNSKSKVSSQFDPNKQTPSGKKCIAAKKIKQSVGNKSMSFPTGKSDRGFRYNWPQR

SEQ ID NO: 852210 - protein, 762 aa, Homo sapiens
SGLLGRQALARRAVQAEKMAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFLPKIFIKPNAQKPLPQALSKERRERPQDRPEDLDVPPALADFIHQQRTQQVEQDMFAHPYQYELNHFTPADAVLQKPQPQLYRPIEETPCHFISSLDELVELNEKLLNCQEFAVDLEHHSYRSFLGLTCLMQISTRTEDFIIDTLELRSDMYILNESLTDPAIVKVFHGADSDIEWLQKDFGLYVVNMFDTHQAARLLNLGRHSLDHLLKLYCNVDSNKQYQLADWRIRPLPEEMLSYARDDTHYLLYIYDKMRLEMWERGNGQPVQLQVVWQRSRDICLKKFIKPIFTDESYLELYRKQKKHLNTQQLTAFQLLFAWRDKTARREDESYGYVLPNHMMLKIAEELPKEPQGIIACCNPVPPLVRQQINEMHLLIQQAREMPLLKSEVAAGVKKSGPLPSAERLENVLFGPHDCSHAPPDGYPIIPTSGSVPVQKQASLFPDEKEDNLLGTTCLIATAVITLFNEPSAEDSKKGPLTVAQKKAQNIMESFENPFRMFLPSLGHRAPVSQAAKFDPSTKIYELPGNRQRRRAKLQQNRPSPSDSRSC

SEQ ID NO: 852211 - protein, 826 aa, Homo sapiens
SGLLGRQALARRAVQAEKMAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFLPKIFIKPNAQKPLPQALSKERRERPQDRPEDLDVPPALADFIHQQRTQQVEQDMFAHPYQYELNHFTPADAVLQKPQPQLYRPIEETPCHFISSLDELVELNEKLLNCQEFAVDLEHHSYRSFLGLTCLMQISTRTEDFIIDTLELRSDMYILNESLTDPAIVKVFHGADSDIEWLQKDFGLYVVNMFDTHQAARLLNLGRHSLDHLLKLYCNVDSNKQYQLADWRIRPLPEEMLSYARDDTHYLLYIYDKMRLEMWERGNGQPVQLQVVWQRSRDICLKKFIKPIFTDESYLELYRKQKKHLNTQQLTAFQLLFAWRDKTARREDESYGYVLPNHMMLKIAEELPKEPQGIIACCNPVPPLVRQQINEMHLLIQQAREMPLLKSEVAAGVKKSGPLPSAERLENVLFGPHDCSHAPPDGYPIIPTSGSVPVQKQASLFPDEKEDNLLGTTCLIATAVITLFNEPSAEDSKKGPLTVAQKKAQNIMESFENPFRMFLPSLGHRAPVSQAAKFDPSTKIYEISNRWKLAQVQVQKDSKEAVKKKAAEQTAARTAGLNVRNGHSRQVDKCERKRQGRPKNREVIREAGENAYAPGGHTLPTAVKAGPEATR

SEQ ID NO: 852212 - protein, 805 aa, Homo sapiens
SGLLGRQALARRAVQAEKMAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFLPKIFIKPNAQKPLPQALSKERRERPQDRPEDLDVPPALADFIHQQRTQQVEQDMFAHPYQYELNHFTPADAVLQKPQPQLYRPIEETPCHFISSLDELVELNEKLLNCQEFAVDLEHHSYRSFLGLTCLMQISTRTEDFIIDTLELRSDMYILNESLTDPAIVKVFHGADSDIEWLQKDFGLYVVNMFDTHQAARLLNLGRHSLDHLLKLYCNVDSNKQYQLADWRIRPLPEEMLSYARDDTHYLLYIYDKMRLEMWERGNGQPVQLQVVWQRSRDICLKKFIKPIFTDESYLELYRKQKKHLNTQQLTAFQLLFAWRDKTARREDESYGYVLPNHMMLKIAEELPKEPQGIIACCNPVPPLVRQQINEMHLLIQQAREMPLLKSEVAAGVKKSGPLPSAERLENVLFGPHDCSHAPPDGYPIIPTSGSVPVQKQASLFPDEKEDNLLGTTCLIATAVITLFNEPSAEDSKKGPLTVAQKKAQNIMESFENPFRMFLPSLGHRAPVSQAAKFDPSTKIYEISNRWKLAQVQVQKDSKEAVKKKAAEQTGNTHFLATQSAVKEWLLHTRCFSQVPDTAMNEAPVGLPFC

SEQ ID NO: 852213 - protein, 482 aa, Homo sapiens
ESKQVISRLDAWGNTALLVRREWLTLAHGMRIRMHAWRTISMGHDMRAARSWERGKGHGVCEVHVGVARGQEICLKKFIKPIFTDESYLELYRKQKKHLNTQQLTAFQLLFAWRDKTARREDESYGYVLPNHMMLKIAEELPKEPQGIIACCNPVPPLVRQQINEMHLLIQQAREMPLLKSEVAAGVKKSGPLPSAERLENVLFGPHDCSHAPPDGYPIIPTSGSVPVQKQASLFPDEKEDNLLGTTCLIATAVITLFNEPSAEDSKKGPLTVAQKKAQNIMESFENPFRMFLPSLGHRAPVSQAAKFDPSTKIYEISNRWKLAQVQVQKDSKEAVKKKAAEQTAAREQAKEACKAAAEQAISVRQQVVLENAAKKRERATSDPRTTEQKQEKKRLKISKKPKDPEPPEKEFTPYDYSQSDFKAFAGNSKSKVSSQFDPNKQTPSGKKCIAAKKIKQSVGNKSMSFPTGKSDRGFRYNWPQR

SEQ ID NO: 852214 - protein, 323 aa, Homo sapiens
WSKIYPFKVHVCLDEMPRYFGSEVAAGVKKSGPLPSAERLENVLFGPHDCSHAPPDGYPIIPTSGSVPVQKQASLFPDEKEDNLLGTTCLIATAVITLFNEPSAEDSKKGPLTVAQKKAQNIMESFENPFRMFLPSLGHRAPVSQAAKFDPSTKIYEISNRWKLAQVQVQKDSKEAVKKKAAEQTAAREQAKEACKAAAEQAISVRQQVVLENAAKKRERATSDPRTTEQKQEKKRLKISKKPKDPEPPEKEFTPYDYSQSDFKAFAGNSKSKVSSQFDPNKQTPSGKKCIAAKKIKQSVGNKSMSFPTGKSDRGFRYNWPQR

SEQ ID NO: 852215 - protein, 547 aa, Homo sapiens; identical to SEQ ID NO: 852208

SEQ ID NO: 852216 - protein, 183 aa, Homo sapiens
GWLLYSDPFDPSAKIYKISNRWKLAQVQVQKDSKEAVKKKAAEQTAAREQAKEACKAAAEQAISVRQQVVLENAAKKRERATSDPRTTEQKQEKKRLKISKKPKDPEPPEKEFTPYDYSQSDFKAFAGNSKSKVSSQFDPNKQTPSGKKCIAAKKIKQSVGNKSMSFPTGKSDRGFRYNWPQR

SEQ ID NO: 852217 - protein, 219 aa, Homo sapiens
SGLLGRQALARRAVQAEKMAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFIMY

SEQ ID NO: 852218 - protein, 903 aa, Homo sapiens; identical to SEQ ID NO: 852209

SEQ ID NO: 852219 - protein, 915 aa, Homo sapiens
SGLLGRQALARRAVQAEKMAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFLPKIFIKPNAQKPLPQALSKERRERPQDRPEDLDVPPALADFIHQQRTQQVEQDMFAHPYQYELNHFTPADAVLQKPQPQLYRPIEETPCHFISSLDELVELNEKLLNCQEFAVDLEHHSYRSFLGLTCLMQISTRTEDFIIDTLELRSDMYILNESLTDPAIVKVFHGADSDIEWLQKDFGLYVVNMFDTHQAARLLNLGRHSLDHLLKLYCNVDSNKQYQLADWRIRPLPEEMLSYARDDTHYLLYIYDKMRLEMWERGNGQPVQLQVVWQRSRDICLKKFIKPIFTDESYLELYRKQKKHLNTQQLTAFQLLFAWRDKTARREDESYGYVLPNHMMLKIAEELPKEPQGIIACCNPVPPLVRQQINEMHLLIQQAREMPLLKSEVAAGVKKSGPLPSAERLENVLFGPHDCSHAPPDGYPIIPTSGKVESPPDCPEEGSVPVQKQASLFPDEKEDNLLGTTCLIATAVITLFNEPSAEDSKKGPLTVAQKKAQNIMESFENPFRMFLPSLGHRAPVSQAAKFDPSTKIYEISNRWKLAQVQVQKDSKEAVKKKAAEQTAAREQAKEACKAAAEQAISVRQQVVLENAAKKRERATSDPRTTEQKQEKKRLKISKKPKDPEPPEKEFTPYDYSQSDFKAFAGNSKSKVSSQFDPNKQTPSGKKCIAAKKIKQSVGNKSMSFPTGKSDRGFRYNWPQR

SEQ ID NO: 852220 - protein, 886 aa, Homo sapiens
SGLLGRQALARRAVQAEKMAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPSLSKERRERPQDRPEDLDVPPALADFIHQQRTQQVEQDMFAHPYQYELNHFTPADAVLQKPQPQLYRPIEETPCHFISSLDELVELNEKLLNCQEFAVDLEHHSYRSFLGLTCLMQISTRTEDFIIDTLELRSDMYILNESLTDPAIVKVFHGADSDIEWLQKDFGLYVVNMFDTHQAARLLNLGRHSLDHLLKLYCNVDSNKQYQLADWRIRPLPEEMLSYARDDTHYLLYIYDKMRLEMWERGNGQPVQLQVVWQRSRDICLKKFIKPIFTDESYLELYRKQKKHLNTQQLTAFQLLFAWRDKTARREDESYGYVLPNHMMLKIAEELPKEPQGIIACCNPVPPLVRQQINEMHLLIQQAREMPLLKSEVAAGVKKSGPLPSAERLENVLFGPHDCSHAPPDGYPIIPTSGSVPVQKQASLFPDEKEDNLLGTTCLIATAVITLFNEPSAEDSKKGPLTVAQKKAQNIMESFENPFRMFLPSLGHRAPVSQAAKFDPSTKIYEISNRWKLAQVQVQKDSKEAVKKKAAEQTAAREQAKEACKAAAEQAISVRQQVVLENAAKKRERATSDPRTTEQKQEKKRLKISKKPKDPEPPEKEFTPYDYSQSDFKAFAGNSKSKVSSQFDPNKQTPSGKKCIAAKKIKQSVGNKSMSFPTGKSDRGFRYNWPQR

SEQ ID NO: 852221 - protein, 349 aa, Homo sapiens [sequence omitted]

SEQ ID NO: 852222 - protein, 722 aa, Homo sapiens
SGLLGRQALARRAVQAEKMAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFLPKIFIKPNAQKPLPQALSKERRERPQDRPEDLDVPPALADFIHQQRTQQVEQDMFAHPYQYELNHFTPADAVLQKPQPQLYRPIEETPCHFISSLDELVELNEKLLNCQEFAVDLEHHSYRSFLGLTCLMQISTRTEDFIIDTLELRSDMYILNESLTDPAIVKVFHGADSDIEWLQKDFGLYVVNMFDTHQAARLLNLGRHSLDHLLKLYCNVDSNKQYQLADWRIRPLPEEMLSYARDDTHYLLYIYDKMRLEMWERGNGQPVQLQVVWQRSRDICLKKFIKPIFTDESYLELYRKQKKHLNTQQLTAFQLLFAWRDKTARREDESYGYVLPNHMMLKIAEELPKEPQGIIACCNPVPPLVRQQINEMHLLIQQAREMPLLKSEVAAGVKKSGPLPSAERLENVLFGPHDCSHAPPDGYPIIPTSGSVPVQKQASLFPDEKEDNLLGTTCLIATAVITLFNEPSAEDSKKGPLTVAQKKAQNIMESFENPFRMFLPSTGHRTP

SEQ ID NO: 852223 - protein, 293 aa, Homo sapiens
ACWCLLMQRLENVLFGPHDCSHAPPDGYPIIPTSGSVPVQKQASLFPDEKEDNLLGTTCLIATAVITLFNEPSAEDSKKGPLTVAQKKAQNIMESFENPFRMFLPSLGHRAPVSQAAKFDPSTKIYEISNRWKLAQVQVQKDSKEAVKKKAAEQTAAREQAKEACKAAAEQAISVRQQVVLENAAKKRERATSDPRTTEQKQEKKRLKISKKPKDPEPPEKEFTPYDYSQSDFKAFAGNSKSKVSSQFDPNKQTPSGKKCIAAKKIKQSVGNKSMSFPTGKSDRGFRYNWPQR

SEQ ID NO: 852224 - protein, 185 aa, Homo sapiens
MGDRGPEREEESAVTTPVAEAKSEGDGDGGEGGCWIHQLQRQVLSLAAAREQAKEACKAAAEQAISVRQQVVLENAAKKRERATSDPRTTEQKQEKKRLKISKKPKDPEPPEKEFTPYDYSQSDFKAFAGNSKSKVSSQFDPNKQTPSGKKCIAAKKIKQSVGNKSMSFPTGKSDRGFRYNWPQR

SEQ ID NO: 852225 - protein, 477 aa, Homo sapiens
NSSGAFSRSRLRASALLLRGGSSGAGLGPLKGTGTAATYGVYLGTRGEAAQVRLAMAKQLQARRLDGIDYNPWVEFVKLASEHDVVNLGQGFPDFPPPDFAVEAFQHAVSGDFMLNQYTKTFGYPPLTKILASFFGELLGQEIDPLRNVLVTVGGYGALFTAFQALVDEGDEVIIIEPFFDCYEPMTMMAGGRPVFVSLKPGPIQNGELGSSSNWQLDPMELAGKFTSRTKALVLNTPNNPLGKVFSREELELVASLCQQHDVVCITDEVYQWMVYDGHQHISIASLPGMWERTLTIGSAGKTFSATGWKVGWVLGPDHIMKHLRTVHQNSVFHCPTQSQAAVAESFEREQLLFRQPSSYFVQFPQAMQRCRDHMIRSLQSVGLKPIIPQGSYFLITDISDFKRKMPDLPGAVDEPYDRRFVKWMIKNKGLVAIPVSIFYSVPHQKHFDHYIRFCFVKDEATLQAMDEKLRKWKVEL

SEQ ID NO: 852226 - protein, 427 aa, Homo sapiens
NSSGAFSRSRLRASALLLRGGSSGAGLGPLKGTGTAATYGVYLGTRGEAAQVRLAMAKQLQARRLDGIDYNPWVEFVKLASEHDVVNLGQGFPDFPPPDFAVEAFQHAVSGDFMLNQYTKTFVIIIEPFFDCYEPMTMMAGGRPVFVSLKPGPIQNGELGSSSNWQLDPMELAGKFTSRTKALVLNTPNNPLGKVFSREELELVASLCQQHDVVCITDEVYQWMVYDGHQHISIASLPGMWERTLTIGSAGKTFSATGWKVGWVLGPDHIMKHLRTVHQNSVFHCPTQSQAAVAESFEREQLLFRQPSSYFVQFPQAMQRCRDHMIRSLQSVGLKPIIPQGSYFLITDISDFKRKMPDLPGAVDEPYDRRFVKWMIKNKGLVAIPVSIFYSVPHQKHFDHYIRFCFVKDEATLQAMDEKLRKWKVEL

SEQ ID NO: 852227 - protein, 481 aa, Homo sapiens
NSSGAFSRSRLRASALLLRGGSSGAGLGPLKGTGTAATYGVYLGTRGEAAQVRLAMAKQLQARRLDGIDYNPWVEFVKLASEHDVVNLGQGFPDFPPPDFAVEAFQHAVSGDFMLNQYTKTFGYPPLTKILASFFGELLGQEIDPLRNVLVTVGGYGALFTAFQALVDEGDEVIIIEPFFDCYEPMTMMAGGRPVFVSLKPGPIQNGELGSSSNWQLDPMELAGKFTSRTKALVLNTPNNPLGKVFSREELELVASLCQQHDVVCITDEVYQWMVYDGHQHISIASLPGMWERTLTIGSAGKTFSATGWKVGWVLGPDHIMKHLRTVHQNSVFHCPTQSQAAVAESFEREQLLFRQPSSYFVQFPQAMQRCRDHMIRSLQSVGLKPIIPQGSYFLITDISDFKRKMPDLPGAVDEPYDRRFVKWMIKNKVGWASARQPCMVSQVVCCSRVPRQEAPGLDLSPASAVNLGAGLYPLQRKYGG

SEQ ID NO: 852228 - protein, 116 aa, Homo sapiens
GITGMRHHTRPIFVFLVETGFSHVGQAGLELLTSGDPPVSASQSAGIIGVSHRTWPCSSDFDAALGAGLELTLLPRLVVGTSLSPPEPRPAGPRGRVETCPSSSPGLGGHPCLHLL

SEQ ID NO: 852229 - protein, 265 aa, Homo sapiens
VAEKNVGSPAPRPTSHLGLANPQERKVPQGPQSPCEVPAAEGILRTGGAKLPIQGHPAKLAMAKQLQARRLDGIDYNPWVEFVKLASEHDVVNLGQGFPDFPPPDFAVEAFQHAVSGDFMLNQYTKTFGYPPLTKILASFFGELLGQEIDPLRNVLVTVGGYGALFTAFQALVDEGDEVIIIEPFFDCYEPMTMMAGGRPVFVSLKPGPIQNGELGSSSNWQLDPMELAGKFTSRTKALVLNTPNNPLGKVSPGKARKLVATICT

SEQ ID NO: 852230 - protein, 422 aa, Homo sapiens
MAKQLQARRLDGIDYNPWVEFVKLASEHDVVNLGQGFPDFPPPDFAVEAFQHAVSGDFMLNQYTKTFGYPPLTKILASFFGELLGQEIDPLRNVLVTVGGYGALFTAFQALVDEGDEVIIIEPFFDCYEPMTMMAGGRPVFVSLKPGPIQNGELGSSSNWQLDPMELAGKFTSRTKALVLNTPNNPLGKVFSREELELVASLCQQHDVVCITDEVYQWMVYDGHQHISIASLPGMWERTLTIGSAGKTFSATGWKVGWVLGPDHIMKHLRTVHQNSVFHCPTQSQAAVAESFEREQLLFRQPSSYFVQFPQAMQRCRDHMIRSLQSVGLKPIIPQGSYFLITDISDFKRKMPDLPGAVDEPYDRRFVKWMIKNKGLVAIPVSIFYSVPHQKHFDHYIRFCFVKDEATLQAMDEKLRKWKVEL

SEQ ID NO: 852231 - protein, 134 aa, Homo sapiens
MAKQLQARRLDGIDYNPWVEFVKLASEHDVVNLGQGFPDFPPPDFAVEAFQHAVSGDFMLNQYTKTFGYPPLTKILASFFGELLGQEIDPLRNVLVTVGGYGALFTAFQALVDEGDEVIIIEPFFDCYDRPSSS

SEQ ID NO: 852232 - protein, 364 aa, Homo sapiens
MSLAGGRAPRKTAGNRLSGLLEAEEEDEFYQTTYGGFTEESGDDEYQGDQSDTEDEVDSDFDIDEGDEPSSDGEAEEPRRKRRVVTKAYKEPLKSLRPRKVNTPAGSSQKAREEKALLPLELQDDGSDSRKSMRQSTAEHTRQTFLRVQERQGQSRRRKGPHCERPLTQEELLREAKITEELNLRSLETYERLEADKKKQVHKKRKCPGPIITYHSVTVPLVGEPGPKEENVDIEGLDPAPSVSALTPHAGTGPVNPPARCSRTFITFSDDATFEEWFPQGRPPKVPVREVCPVTHRPALYRDPVTDIPYATARAFKIIREAYKKYITAHGLPPTASALGPGPPPPEPLPGSGPRALRQKIVIK

SEQ ID NO: 852233 - protein, 141 aa, Homo sapiens
CLADPFFGQDKKALDPAPSVSALTPHAGTGPVNPPARCSRTFITFSDDATFEEWFPQGRPPKVPVREVCPVTHRPALYRDPVTDIPYATARAFKIIREAYKKYITAHGLPPTASALGPGPPPPEPLPGSGPRALRQKIVIK

SEQ ID NO: 852234 - protein, 212 aa, Homo sapiens
MVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQVVPRCKGHLDKGLGLDQKTAS

SEQ ID NO: 852235 - protein, 258 aa, Homo sapiens
MGPGKKGRCREEGPGRGRRAWIIRGSGSSRQGWVGSVESSKRSANVTRQRQIEQILPALAAGSCFHPAFILSCRFSSRTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 852236 - protein, 4088 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLFSCLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLASSLQYEMLLLTDSISKEDSCWELRLRCALSLFLMAVNIKTPVVVENITLMCLRILQKLIKPPAPTSKKNKDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEELENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 852237 - protein, 4194 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLFSCLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKAKSSGGPSHLLDSSFVTYNTLHAALPACTFPKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQVVPRCKGHLDKGLGLDQKTASYGEITLGGEPDSFLLGLQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLASSLQYEMLLLTDSISKEDSCWELRLRCALSLFLMAVNIKTPVVVENITLMCLRILQKLIKPPAPTSKKNKDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEELENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 852238 - protein, 899 aa, Homo sapiens
NQLGPFTAEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEELENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 852239 - protein, 863 aa, Homo sapiens
PNKSVKLFRKYTEMYRLKKGIISQWRIYYCCNWCKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEELENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 852240 - protein, 1025 aa, Homo sapiens
STYTKIGTIQRRLAWPLRKDDTQIREAFHILGGMSLAGGRAPRKTAGNRLSGLLEAEEEDEFYQTTYGGFTEESGDDEYQGDQSDTEDEVDSDFDIDEGDEPSSDGEAEEPRRKRRVVTKAYKEPLKSLRPRKVNTPAGSSQKAREEKALLPLELQDDGSDSRKSMRQSTAEHTRQTFLRVQERQGQSRRRKGPHCERPLTQEELLREAKITEELNLRSLETYERLEADKKKQVHKKRKCPGPIITYHSVTVPLVGEPGPKEENVDIEGLDPAPSVSALTPHAGTGPVNPPARCSRTFITFSDDATFEEWFPQGRPPKVPVREVCPVTHRPALYRDPVTDIPYATARAFKIIREAYKKYITAHGLPPTASANKRLEALLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEELENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 852241 - protein, 683 aa, Homo sapiens
MPLLEPSRSFVRLTRSTLLPMDCRPLPQPTSAWRRLLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEELENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 852242 - protein, 683 aa, Homo sapiens; identical to SEQ ID NO: 852241

SEQ ID NO: 852243 - protein, 3858 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLFSCLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLASSLQYEMLLLTDSISKEDSCWELRLRCALSLFLMAVNIKTPVVVENITLMCLRILQKLIKPPAPTSKKNKDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCIMPTPSATGSFRSGDLMSLNQLLPLAWQDTTLTSRNVQASGSPRISSTSTTSNCSSCASPWSSRSAQTLAGAAGRATST

SEQ ID NO: 852244 - protein, 4123 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLFSCLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLASSLQYEMLLLTDSISKEDSCWELRLRCALSLFLMAVNIKTPVVVENITLMCLRILQKLIKPPAPTSKKNKDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEELENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 852245 - protein, 4123 aa, Homo sapiens; identical to SEQ ID NO: 852244

SEQ ID NO: 852246 - protein, 4123 aa, Homo sapiens; identical to SEQ ID NO: 852244

SEQ ID NO: 852247 - protein, 4103 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLFSCLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLASSLQYEMLLLTDSISKEDSCWELRLRCALSLFLMAVNIKTPVVVENITLMCLRILQKLIKPPAPTSKKNKDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEELENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAG

SEQ ID NO: 852248 - protein, 4036 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLFSCLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLASSLQYEMLLLTDSISKEDSCWELRLRCALSLFLMAVNIKTPVVVENITLMCLRILQKLIKPPAPTSKKNKDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEELENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRSVPASGSCCSLFPIISFE

SEQ ID NO: 852249 - protein, 3894 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLFSCLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLASSLQYEMLLLTDSISKEDSCWELRLRCALSLFLMAVNIKTPVVVENITLMCLRILQKLIKPPAPTSKKNKDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEELENKPRKQQGYSTVSHFNIVHYDCHLAAVRLARGREEWESAALQNANTKCNGLLPVWGPHVPESAFATCLARACTYLGAMSCPGQLHT

SEQ ID NO: 852250 - protein, 397 aa, Homo sapiens
STYTKIGTIQRRLAWPLRKDDTQIREAFHILGGMSLAGGRAPRKTAGNRLSGLLEAEEEDEFYQTTYGGFTEESGDDEYQGDQSDTEDEVDSDFDIDEGDEPSSDGEAEEPRRKRRVVTKAYKEPLKSLRPRKVNTPAGSSQKAREEKALLPLELQDDGSDSRKSMRQSTAEHTRQTFLRVQERQGQSRRRKGPHCERPLTQEELLREAKITEELNLRSLETYERLEADKKKQVHKKRKCPGPIITYHSVTVPLVGEPGPKEENVDIEGLDPAPSVSALTPHAGTGPVNPPARCSRTFITFSDDATFEEWFPQGRPPKVPVREVCPVTHRPALYRDPVTDIPYATARAFKIIREAYKKYITAHGLPPTASALGPGPPPPEPLPGSGPRALRQKIVIK

SEQ ID NO: 852251 - protein, 106 aa, Homo sapiens
MRFGPKTSEYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 852252 - protein, 3317 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLFSCLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLASSLQYEMLLLTDSISKEDSCWELRLRCALSLFLMAVNIKTPVVVENITLMCLRILQKLIKPPAPTSKKNKDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSISL

SEQ ID NO: 852253 - protein, 397 aa, Homo sapiens; identical to SEQ ID NO: 852250

SEQ ID NO: 852254 - protein, 397 aa, Homo sapiens; identical to SEQ ID NO: 852250

SEQ ID NO: 852255 - protein, 2265 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLFSCLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLPRESVFVYNVFFHFWRILFV

SEQ ID NO: 852256 - protein, 2147 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLFSCLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMSNIGPSSM

SEQ ID NO: 852257 - protein, 1792 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLFSCLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGRRPCQEQSGPLALHRKRGFGSY

SEQ ID NO: 852258 - protein, 307 aa, Homo sapiens
STYTKIGTIQRRLAWPLRKDDTQIREAFHILGGMSLAGGRAPRKTAGNRLSGLLEAEEEDEFYQTTYGGFTEESGDDEYQGDQSDTEDEVDSDFDIDEGDEPSSDGEAEEPRRKRRVVTKAYKEPLKSLRPRKVNTPAGSSQKAREEKALLPLELQDDGSDSRKSMRQSTAEHTRQTFLRVQERQGQSRRRKGPHCERPLTQEELLREAKITEELNLRSLETYERLEADKKKQVHKKRKCPGPIITYHSVTVPLVGEPGPKEENVDIEGSPAKEEITLHFPLPTSAGSTGHLNPHLSSFPVNKSPSI

SEQ ID NO: 852259 - protein, 230 aa, Homo sapiens
STYTKIGTIQRRLAWPLRKDDTQIREAFHILGGMSLAGGRAPRKTAGNRLSGLLEAEEEDEFYQTTYGGFTEESGDDEYQGDQSDTEDEVDSDFDIDEGDEPSSDGEAEEPRRKRRVVTKAYKEPLKSLRPRKVNTPAGSSQKAREEKALLPLELQDDGSDSRKSMRQSTAEHTRQTFLRVQERQGQSRRRKGPHCERPLTQEELLREAKITEELNLRSLDLILLPRCLH

SEQ ID NO: 852260 - protein, 269 aa, Homo sapiens
STYTKIGTIQRRLAWPLRKDDTQIREAFHILGGMSLAGGRAPRKTAGNRLSGLLEAEEEDEFYQTTYGGFTEESGDDEYQGDQSDTEDEVDSDFDIDEGDEPSSDGEAEEPRRKRRVVTKAYKEPLKSLRPRKVNTPAGSSQKAREEKALLPLELQDDGSDSRKSMRQSTAEHTRQTFLRVQERQGQSRRRKGPHCERPLTQEELLREAKITEELNLRSLGKSVVSEKVSRGAEGHEKNHETWRTKELERWKFGMMESEGRNGGAVPLS

SEQ ID NO: 852261 - protein, 116 aa, Homo sapiens
STYTKIGTIQRRLAWPLRKDDTQIREAFHILGGMSLAGGRAPRKTAGNRLSGLLEAEEEDEFYQTTYGGFTEESGDDEYQGDQSDTEDEVDSDFDIDEGDEPSSDGEAEEQKIVIK

SEQ ID NO: 852262 - protein, 179 aa, Homo sapiens
QAPSGDWGFFDSGDKDDDDDDDADEKMQSSGIPNGGHIRQESQEQSEVDHGDFEMVVSLWQQEKEEEELHNSPLALIQWTSKSYHLPWDTDRAFSLQSESMVLETAENVNNGNPSPLEALLAGAEGFPPMLDIPPDADDETMVELAIALSLQQDQQGRRPCQEQSGPLALHRKRGFGSY

SEQ ID NO: 852263 - protein, 75 aa, Homo sapiens
DKDQLVMLLDQINSTFVRSNPSVLQGLLRIIPYLSFGEVEKMQILVERFKPYCNFDKYVTLISYSEMRVSTKTPN

SEQ ID NO: 852264 - protein, 153 aa, Homo sapiens
SLAPIMWTKRKALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 852265 - protein, 142 aa, Homo sapiens
NQLGPFTAEMLEDMTTGTESETKAFMAVCIETAKRYNLDDYRTPVFIFERLCSIIYPEENEVTEFFVTLEKDPQQEDFLQGRMPGNPYSSISALEISKRGDAAQKTDTSHHDQDHPTFNKITPNLAEFLQPIPPAAHQSTAS

SEQ ID NO: 852266 - protein, 4123 aa, Homo sapiens; identical to SEQ ID NO: 852244

SEQ ID NO: 852267 - protein, 2855 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLFSCLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQVVPRCKGHLDKGLGLDQKTASYGEITLGGEPDSFLLGLQDDSGTAGGISSTSASVNRYILQLAQEYCGDCKNSFDELSKIIQVESGEQLLGVFCPSVTGVVFTAVLLLSHLAVQVLVLSLPNLAEKAGRWLHQTASPPP

SEQ ID NO: 852268 - protein, 3893 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLFSCLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLVSRPEQAQLSSLTSPHMPCVSQLPLPGPAVTEEGRSRTLPQNGFPREEPGAQGSPSVLCLCWSHLGPEIVLIVKSRWTGGKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEELENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 852269 - protein, 4038 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLFSCLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLASSLQYEMLLLTDSISKEDSCWELRLRCALSLFLMAVNIKTPVVVENITLMCLRILQKLIKPPAPTSKKNKDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLGNLLLTGDKDQLVMLLDQINSTFVRSNPSVLQGCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEELENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 852270 - protein, 3750 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLFSCLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLASSLQYEMLLLTDSISKEDSCWELRLRCALSLFLMAVNIKTPVVVENITLMCLRILQKLIKPPAPTSKKNKDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMT

SEQ ID NO: 852271 - protein, 683 aa, Homo sapiens; identical to SEQ ID NO: 852241

SEQ ID NO: 852272 - protein, 4123 aa, Homo sapiens; identical to SEQ ID NO: 852244

SEQ ID NO: 852273 - protein, 556 aa, Homo sapiens
RVEKPTLLRLAIPYHRASKGPPRMLVCRGRCLSRWTQRRLRSTNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEELENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 852274 - protein, 4123 aa, Homo sapiens; identical to SEQ ID NO: 852244

SEQ ID NO: 852275 - protein, 4128 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLFSCLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLASSLQYEMLLLTDSISKEDSCWELRLRCALSLFLMAVNIKTPVVVENITLMCLRILQKLIKPPAPTSKKNKDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEELENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLDKYGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQGPT

SEQ ID NO: 852276 - protein, 3445 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLFSCLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLASSLQYEMLLLTDSISKEDSCWELRLRCALSLFLMAVNIKTPVVVENITLMCLRILQKLIKPPAPTSKKNKDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDETMTQYSYCIYICCNYCKKEREQKKKKKKKKFLSIMWCEKR

SEQ ID NO: 852277 - protein, 397 aa, Homo sapiens; identical to SEQ ID NO: 852250

SEQ ID NO: 852278 - protein, 2307 aa, Homo sapiens
VTYEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLSPGLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSS

SEQ ID NO: 852279 - protein, 406 aa, Homo sapiens
STYTKIGTIQRRLAWPLRKDDTQIREAFHILGGMSLAGGRAPRKTAGNRLSGLLEAEEEDEFYQTTYGGFTEESGDDEYQGDQSDTEDEVDSDFDIDEGDEPSSDGEAEEPRRKRRVVTKAYKEPLKSLRPRKVNTPAGSSQKAREEKALLPLELQDDGSDSRKSMRQSTAEHTRQTFLRVQERQGQSRRRKGPHCERPLTQEELLREAKITEELNLRSLETYERLEADKKKQVHKKRKCPGPIITYHSVTVPLVGEPGPKEENVDIEGLDPAPSVSALTPHAGTGPVNPPARCSRTFITFSDDATFEEWFPQGRPPKVPVREVCPVTHRPALYRDPVTDIPYATARAFKIIREAYKKYITAHGLPPTASALGPGPPPPEPLPGSGPRALRVISDLCLICFFFLFP

SEQ ID NO: 852280 - protein, 2028 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPGKLPGPELTLKQIKFHLRFTIVDNFLFSCLEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICEVFLLWVHGFGER

SEQ ID NO: 852281 - protein, 269 aa, Homo sapiens
STYTKIGTIQRRLAWPLRKDDTQIREAFHILGGMSLAGGRAPRKTAGNRLSGLLEAEEEDEFYQTTYGGFTEESGDDEYQGDQSDTEDEVDSDFDIDEGDEPSSDGEAEEPRRKRRVVTKAYKEPLKSLRPRKVNTPAGSSQKAREEKALLPLELQDDGSDSRKSMRQSTAEHTRQTFLRVQERQGQSRRRKGPHCERPLTQEELLREAKITEELNLRSLETYERLEADKKKQVHKKRKCPGPIITYHSVTVPLVGEPGPKEENVDIEG

SEQ ID NO: 852282 - protein, 1337 aa, Homo sapiens
DLEVPPQAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFSESPTPGADSVLIVTAKLGATGLWLSNILGSLHSADFSVLSSGNFELHLMY

SEQ ID NO: 852283 - protein, 157 aa, Homo sapiens
STYTKIGTIQRRLAWPLRKDDTQIREAFHILGGMSLAGGRAPRKTAGNRLSGLLEAAYTGTLLQTYPMPLLEPSRSFVRLTRSTLLPMDCRPLPQPWAPARHLLSPSLALGPEPCARKLSLNEEMSSPQKLLSCPDWGSCCSVSSPCFSPLSSLIFA

SEQ ID NO: 852284 - protein, 52 aa, Homo sapiens
MAPGSRCGACLGNVVELLLSRGWFLFQMEHLKACAEIAAQRTINWQKFCIKD

SEQ ID NO: 852285 - protein, 83 aa, Homo sapiens
LVKRTPSSGMSSTMKESAFQSEPRISESLVRHASTSSPADKAKVTISDGKVADEEKPKKSSLCRTVEGCREELQNQVGLTDAP

SEQ ID NO: 852286 - protein, 587 aa, Homo sapiens [sequence omitted]

SEQ ID NO: 852287 - protein, 569 aa, Homo sapiens
MEHVSSPCDSNSSSLPRGDVLGSSRPHRRRPCVQQSLSSSFTCEKDPECKVDHKKGLRKSENPRGPLVLPAGGGAQDESGSRIHHKNWTLASKRGRNSAQKASLCLNGSSLSEDDTERDMGSKGGSWAAPSLPSGVREDDPCANAEGHDPGLPLGSLTAPPAPEPSACSEPGECPAKKRPRLDGSQRPPAVQLEPMAAGAAPSPGPGPGPRESVTPRSTARLGPPPSHASADATRCLPCPDSQKLEKECQSSEESMGSNSMRSILEEDEEDEEPPRVLLYHEPRSFEVGMLVWHKHKKYPFWPAVVKSVRQRDKKASVLYIEGHMNPKMKGFTVSLKSLKHFDCKEKQTLLNQAREDFNQDIGWCVSLITDYRVRLGCGSFAGSFLEYYAADISYPVRKSIQQDVLGTKLPQLSKGSPEEPVVGCPLGQRQPCRKMLPDRSRAARDRANQKLVEYIVKAKGAESHLRAILKSRKPSRWLQTFLSSSQYVTCVETYLEDEGQLDLVVKYLQGVYQEVGAKVLQRTNGDRIRFILDVLLPEAIICAISAVDEVDYKTAEEKYIKGPSLSYR

SEQ ID NO: 852288 - protein, 587 aa, Homo sapiens [sequence omitted]

SEQ ID NO: 852289 - protein, 569 aa, Homo sapiens; identical to SEQ ID NO: 852287

SEQ ID NO: 852290 - protein, 710 aa, Homo sapiens [sequence omitted]

SEQ ID NO: 852291 - protein, 587 aa, Homo sapiens [sequence omitted]

SEQ ID NO: 852292 - protein, 587 aa, Homo sapiens [sequence omitted]

SEQ ID NO: 852293 - protein, 569 aa, Homo sapiens; identical to SEQ ID NO: 852287

SEQ ID NO: 852294 - protein, 96 aa, Homo sapiens
AVAEAVSAGGADGSGWRAGPPLLRPLRPPCPGLGRRAGESRGPGHIGVRPGSTLCQIIATCHMSVNDGGCQVCPLPMGKAIMACEGFGPNRDFNKK

SEQ ID NO: 852295 - protein, 587 aa, Homo sapiens [sequence omitted]

SEQ ID NO: 852296 - protein, 587 aa, Homo sapiens [sequence omitted]

SEQ ID NO: 852297 - protein, 587 aa, Homo sapiens [sequence omitted]

SEQ ID NO: 852298 - protein, 587 aa, Homo sapiens [sequence omitted]

SEQ ID NO: 852299 - protein, 109 aa, Homo sapiens
MGQTASTSPARLACPECISLHCVVTAQPVTAVSVIGADGYAGVPGWPQQSGSLWEPWGGVTNRIVLCPPWQKRSLCMEAQPRSRLEKRLPGCGCRVGSGPQHGAGAAGC

SEQ ID NO: 852300 - protein, 587 aa, Homo sapiens [sequence omitted]

SEQ ID NO: 852301 - protein, 189 aa, Homo sapiens
MSRVPGPGGLGAAFSPLAGLHLALAGGLALRGCDPLPPGPPQPTTATGEEIGTRLSQMQGAVRDEAARTLVSGPWDSGGARGGGCSGPRCSLTFVSLASARLREQETRPWPGSSASHARTLGSVLSGAVGHTPEEAGVRAVGLGPLLVAVSGTRGGQYHRLRRGSAALHVRASYCLMENPPEPPSIVGS

SEQ ID NO: 852302 - protein, 189 aa, Homo sapiens; identical to SEQ ID NO: 852301

SEQ ID NO: 852303 - protein, 130 aa, Homo sapiens
MVSGEHQGHLVPSWPPVHKTRKDFAAIRGEVLPFSFPLPIVRFAVVLSLPGQSGLSPRFEKQLVVCLKFQSRAQGRERVAWHWGWWHPLFEALSWGARGRSEVELSASHPSGCAFSQAFSLAPTSFAHCG

SEQ ID NO: 852304 - protein, 411 aa, Homo sapiens
AAATSTPRHLLCGSCASQAQCRSARRSGCSCPARRRPARAVGCGLRPRCWPALHGCGLCGARCSATLRRAAWDNAAMVRRDRLRRMREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPSESELWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 852305 - protein, 411 aa, Homo sapiens; identical to SEQ ID NO: 852304

SEQ ID NO: 852306 - protein, 326 aa, Homo sapiens
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPSESELWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 852307 - protein, 326 aa, Homo sapiens; identical to SEQ ID NO: 852306

SEQ ID NO: 852308 - protein, 391 aa, Homo sapiens
AAATSTPRHLLCGSCASQAQCRSARRSGCSCPARRRPARAVGCGLRPRCWPALHGCGLCGARCSATLRRAAWDNAAMVRRDRLRRMREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 852309 - protein, 411 aa, Homo sapiens; identical to SEQ ID NO: 852304

SEQ ID NO: 852310 - protein, 292 aa, Homo sapiens
MREWWVQVGLLAVPLLAAYLHIPPPQLSPALHSWKSSGKFFTYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPSESELWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 852311 - protein, 411 aa, Homo sapiens; identical to SEQ ID NO: 852304

SEQ ID NO: 852312 - protein, 411 aa, Homo sapiens; identical to SEQ ID NO: 852304

SEQ ID NO: 852313 - protein, 411 aa, Homo sapiens; identical to SEQ ID NO: 852304

SEQ ID NO: 852314 - protein, 411 aa, Homo sapiens; identical to SEQ ID NO: 852304

SEQ ID NO: 852315 - protein, 483 aa, Homo sapiens
AAATSTPRHLLCGSCASQAQCRSARRSGCSCPARRRPARAVGCGLRPRCWPALHGCGLCGARCSATLRRAAWDNAAMVRRDRLRRMREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPSESELWDMWAGIRNNDGNLVIDKVRSYPLLWFPETCFCGEVGIACSVPWLAYSLITGRLMMTYGANQKVMVYMKKEIENKSETGLFVSIKCFKVLNHGCESSLVPPSRYKALPFAYLSAATGSERADFSFSVLYKEFPCLGSNENVDTFTRDPEVVIAVTTWDKTLTSSHLAQCSFQCFY

SEQ ID NO: 852316 - protein, 411 aa, Homo sapiens; identical to SEQ ID NO: 852304

SEQ ID NO: 852317 - protein, 326 aa, Homo sapiens; identical to SEQ ID NO: 852306

SEQ ID NO: 852318 - protein, 374 aa, Homo sapiens
AAATSTPRHLLCGSCASQAQCRSARRSGCSCPARRRPARAVGCGLRPRCWPALHGCGLCGARCSATLRRAAWDNAAMVRRDRLRRMREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 852319 - protein, 401 aa, Homo sapiens
AAATSTPRHLLCGSCASQAQCRSARRSGCSCPARRRPARAVGCGLRPRCWPALHGCGLCGARCSATLRRAAWDNAAMVRRDRLRRMREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPSESELWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 852320 - protein, 411 aa, Homo sapiens; identical to SEQ ID NO: 852304

SEQ ID NO: 852321 - protein, 289 aa, Homo sapiens
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 852322 - protein, 364 aa, Homo sapiens
AAATSTPRHLLCGSCASQAQCRSARRSGCSCPARRRPARAVGCGLRPRCWPALHGCGLCGARCSATLRRAAWDNAAMVRRDRLRRMREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPASIVEALLRHLGLQNRRINLLSHDYGDIVAQELLYRYKQNRSGRLTIKSLCLSNGGIFPETHRPLLLQKLLKDGGVLSPILTRLMNFFDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 852323 - protein, 261 aa, Homo sapiens
AAATSTPRHLLCGSCASQAQCRSARRSGCSCPARRRPARAVGCGLRPRCWPALHGCGLCGARCSATLRRAAWDNAAMVRRDRLRRMREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGNCLGGR

SEQ ID NO: 852324 - protein, 2432 aa, Homo sapiens
MKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQEFFKGYLKGEHGRLLSLWREVVTFRRHFLEMKSATDRDLMELKAEHVRLSGSLLTCCLRLTVGAQSREPNGSGRMDGREPAQLLLLLAKTQELEKEAHERSQELIQLKSQGDLEKAELQDRVTELSALLTQSQKQNEDYEKMIKALRETVEILETNHTELMEHEASLSRNAQEEKLSLQQVIKDITQVMVEEGDNIAQGSGHENSLELDSSIFSQFDYQDADKALTLVRSVLTRRRQAVQDLRQQLAGCQEAVNLLQQQHDQWEEEGKALRQRLQKLTGERDTLAGQTVDLQGEVDSLSKERELLQKAREELRQQLEVLEQEAWRLRRVNVELQLQGDSAQGQKEEQQEELHLAVRERERLQEMLMGLEAKQSESLSELITLREALESSHLEGELLRQEQTEVTAALARAEQSIAELSSSENTLKTEVADLRAAAVKLSALNEALALDKVGLNQQLLQLEEENQSVCSRMEAAEQARNALQVDLAEAEKRREALWEKNTHLEAQLQKAEEAGAELQADLRDIQEEKEEIQKKLSESRHQQEAATTQLEQLHQEAKRQEEVLARAVQEKEALVREKAALEVRLQAVERDRQDLAEQLQGLSSAKELLESSLFEAQQQNSVIEVTKGQLEVQIQTVTQAKEVIQGEVRCLKLELDTERSQAEQERDAAARQLAQAEQEGKTALEQQKAAHEKEVNQLREKWEKERSWHQQELAKALESLEREKMELEMRLKEQQTEMEAIQAQREEERTQAESALCQMQLETEKERVSLLETLLQTQKELADASQQLERLRQDMKVQKLKEQETTGILQTQLQEAQRELKEAARQHRDDLAALQEESSSLLQDKMDLQKQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQDELELTRRALEKERLHSPGATSTAELGSRGEQGVQLGEVSGVEAEPSPDGMEKQSWRQRLEHLQQAVARLEIDRSRLQRHNVQLRSTLEQVERERRKLKREAMRAAQAGSLEISKATASSPTQQDGRGQKNSDAKCVAELQKEVVLLQAQLTLERKQKQDYITRSAQTSRELAGLHHSLSHSLLAVAQAPEATVLEAETRRLDESLTQSLTSPGPVLLHPSPSTTQAASR

SEQ ID NO: 852325 - protein, 2432 aa, Homo sapiens; identical to SEQ ID NO: 852324

SEQ ID NO: 852326 - protein, 2138 aa, Homo sapiens
MIKALRETVEILETNHTELMEHEASLSRNAQEEKLSLQQVIKDITQVMVEEGDNIAQGSGHENSLELDSSIFSQFDYQDADKALTLVRSVLTRRRQAVQDLRQQLAGCQEAVNLLQQQHDQWEEEGKALRQRLQKLTGERDTLAGQTVDLQGEVDSLSKERELLQKAREELRQQLEVLEQEAWRLRRVNVELQLQGDSAQGQKEEQQEELHLAVRERERLQEMLMGLEAKQSESLSELITLREALESSHLEGELLRQEQTEVTAALARAEQSIAELSSSENTLKTEVADLRAAAVKLSALNEALALDKVGLNQQLLQLEEENQSVCSRMEAAEQARNALQVDLAEAEKRREALWEKNTHLEAQLQKAEEAGAELQADLRDIQEEKEEIQKKLSESRHQQEAATTQLEQLHQEAKRQEEVLARAVQEKEALVREKAALEVRLQAVERDRQDLAEQLQGLSSAKELLESSLFEAQQQNSVIEVTKGQLEVQIQTVTQAKEVIQGEVRCLKLELDTERSQAEQERDAAARQLAQAEQEGKTALEQQKAAHEKEVNQLREKWEKERSWHQQELAKALESLEREKMELEMRLKEQQTEMEAIQAQREEERTQAESALCQMQLETEKERVSLLETLLQTQKELADASQQLERLRQDMKVQKLKEQETTGILQTQLQEAQRELKEAARQHRDDLAALQEESSSLLQDKMDLQKQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQDELELTRRALEKERLHSPGATSTAELGSRGEQGVQLGEVSGVEAEPSPDGMEKQSWRQRLEHLQQAVARLEIDRSRLQRHNVQLRSTLEQVERERRKLKREAMRAAQAGSLEISKATASSPTQQDGRGQKNSDAKCVAELQKEVVLLQAQLTLERKQKQDYITRSAQTSRELAGLHHSLSHSLLAVAQAPEATVLEAETRRLDESLTQSLTSPGPVLLHPSPSTTQAASR

SEQ ID NO: 852327 - protein, 1810 aa, Homo sapiens
MEAAEQARNALQVDLAEAEKRREALWEKNTHLEAQLQKAEEAGAELQADLRDIQEEKEEIQKKLSESRHQQEAATTQLEQLHQEAKRQEEVLARAVQEKEALVREKAALEVRLQAVERDRQDLAEQLQGLSSAKELLESSLFEAQQQNSVIEVTKGQLEVQIQTVTQAKEVIQGEVRCLKLELDTERSQAEQERDAAARQLAQAEQEGKTALEQQKAAHEKEVNQLREKWEKERSWHQQELAKALESLEREKMELEMRLKEQQTEMEAIQAQREEERTQAESALCQMQLETEKERVSLLETLLQTQKELADASQQLERLRQDMKVQKLKEQETTGILQTQLQEAQRELKEAARQHRDDLAALQEESSSLLQDKMDLQKQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQDELELTRRALEKERLHSPGATSTAELGSRGEQGVQLGEVSGVEAEPSPDGMEKQSWRQRLEHLQQAVARLEIDRSRLQRHNVQLRSTLEQVERERRKLKREAMRAAQAGSLEISKATASSPTQQDGRGQKNSDAKCVAELQKEVVLLQAQLTLERKQKQDYITRSAQTSRELAGLHHSLSHSLLAVAQAPEATVLEAETRRLDESLTQSLTSPGPVLLHPSPSTTQAASR

SEQ ID NO: 852328 - protein, 1437 aa, Homo sapiens
MPLIFQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQDELELTRRALEKERLHSPGATSTAELGSRGEQGVQLGEVSGVEAEPSPDGMEKQSWRQRLEHLQQAVARLEIDRSRLQRHNVQLRSTLEQVERERRKLKREAMRAAQAGSLEISKATASSPTQQDGRGQKNSDAKCVAELQKEVVLLQAQLTLERKQKQDYITRSAQTSRELAGLHHSLSHSLLAVAQAPEATVLEAETRRLDESLTQSLTSPGPVLLHPSPSTTQAASR

SEQ ID NO: 852329 - protein, 2360 aa, Homo sapiens
MKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQEFFKGYLKGEHGRLLSLWREVVTFRRHFLEMKSATDRDLMELKAEHVRLSGSLLTCCLRLTVGAQSREPNGSGRMDGREPAQLLLLLAKTQELEKEAHERSQELIQLKSQGDLEKAELQDRVTELSALLTQSQKQNEDYEKMIKALRETVEILETNHTELMEHEASLSRNAQEEKLSLQQVIKDITQVMVEEGDNIAQGSGHENSLELDSSIFSQFDYQDADKALTLVRSVLTRRRQAVQDLRQQLAGCQEAVNLLQQQHDQWEEEGKALRQRLQKLTGERDTLAGQTVDLQGEVDSLSKERELLQKAREELRQQLEVLEQEAWRLRRVNVELQLQGDSAQGQKEEQQEELHLAVRERERLQEMLMGLEAKQSESLSELITLREALESSHLEGELLRQEQTEVTAALARAEQSIAELSSSENTLKTEVADLRAAAVKLSALNEALALDKVGLNQQLLQLEEENQSVCSRMEAAEQARNALQVDLAEAEKRREALWEKNTHLEAQLQKAEEAGAELQADLRDIQEEKEEIQKKLSESRHQQEAATTQLEQLHQEAKRQEEVLARAVQEKEALVREKAALEVRLQAVERDRQDLAEQLQGLSSAKELLESSLFEAQQQNSVIEVTKGQLEVQIQTVTQAKEVIQGEVRCLKLELDTERSQAEQERDAAARQLAQAEQEGKTALEQQKAAHEKEVNQLREKWEKERSWHQQELAKALESLEREKMELEMRLKEQQTEMEAIQAQREEERTQAESALCQMQLETEKERVSLLETLLQTQKELADASQQLERLRQDMKVQKLKEQETTGILQTQLQEAQRELKEAARQHRDDLAALQEESSSLLQDKMDLQKQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQDELELTRRALEKERLHSPGATSTAELGSRGEQGVQLGEVSGVEAEPSPDGMEKQSWRQRLEHLQQAVARLEIDRSRLQRHNVQLRSTLEQVERERRKLKREAMRAAQAGSLEISKATASSPTQQDGRGQKNSDAKCVAELQKEGRAHGKWHADSDTGH

SEQ ID NO: 852330 - protein, 2315 aa, Homo sapiens
MKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQEFFKGYLKGEHGRLLSLWREVVTFRRHFLEMKSATDRDLMELKAEHVRLSGSLLTCCLRLTVGAQSREPNGSGRMDGREPAQLLLLLAKTQELEKEAHERSQELIQLKSQGDLEKAELQDRVTELSALLTQSQKQNEDYEKMIKALRETVEILETNHTELMEHEASLSRNAQEEKLSLQQVIKDITQVMVEEGDNIAQGSGHENSLELDSSIFSQFDYQDADKALTLVRSVLTRRRQAVQDLRQQLAGCQEAVNLLQQQHDQWEEEGKALRQRLQKLTGERDTLAGQTVDLQGEVDSLSKERELLQKAREELRQQLEVLEQEAWRLRRVNVELQLQGDSAQGQKEEQQEELHLAVRERERLQEMLMGLEAKQSESLSELITLREALESSHLEGELLRQEQTEVTAALARAEQSIAELSSSENTLKTEVADLRAAAVKLSALNEALALDKVGLNQQLLQLEEENQSVCSRMEAAEQARNALQVDLAEAEKRREALWEKNTHLEAQLQKAEEAGAELQADLRDIQEEKEEIQKKLSESRHQQEAATTQLEQLHQEAKRQEEVLARAVQEKEALVREKAALEVRLQAVERDRQDLAEQLQGLSSAKELLESSLFEAQQQNSVIEVTKGQLEVQIQTVTQAKEVIQGEVRCLKLELDTERSQAEQERDAAARQLAQAEQEGKTALEQQKAAHEKEVNQLREKWEKERSWHQQELAKALESLEREKMELEMRLKEQQTEMEAIQAQREEERTQAESALCQMQLETEKERVSLLETLLQTQKELADASQQLERLRQDMKVQKLKEQETTGILQTQLQEAQRELKEAARQHRDDLAALQEESSSLLQDKMDLQKQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQDELELTRRALEKERLHSPGATSTAELGSRGEQGVQLGEVSGVEAEPSPDGMEKQARSTQTEDCVMGHGPSAHLQVCQRKSLALLGTQEPQVGGCSQEEEVNLQPWGGPQLTWE

SEQ ID NO: 852331 - protein, 316 aa, Homo sapiens
MKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQEFFKGYLKGEHGRLLSLWREVVTFRRHFLEMKSATDRDLMELKAEHVRLSGSLLTCCLRLTVGAQSREPNGSGRMDGREPAQLLLLLAKTQELEKEAHERSQELIQLKSQGDLEKAELQDRVTELSALLTQSQKQNEDYEKMIKALRETVEILKKLRSMLLKL

SEQ ID NO: 852332 - protein, 274 aa, Homo sapiens [sequence omitted]

SEQ ID NO: 852333 - protein, 68 aa, Homo sapiens
MKVCRMTQLCRRDPLAALSEARESQTEHLGQREGLKALSKCQASWMHGLCGVQGYIQKQWQVLSIHSG

SEQ ID NO: 852334 - protein, 2383 aa, Homo sapiens
MKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQEFFKGYLKGEHGRLLSLWREVVTFRRHFLEMKSATDRDLMELKAEHVRLSGSLLTCCLRLTVGAQSREPNGSGRMDGREPAQLLLLLAKTQELEKEAHERSQELIQLKSQGDLEKAELQDRVTELSALLTQSQKQNEDYEKMIKALRETVEILETNHTELMEHEASLSRNAQEEKLSLQQVIKDITQVMVEEGDNIAQGSGHENSLELDSSIFSQFDYQDADKALTLVRSVLTRRRQAVQDLRQQLAGCQEAVNLLQQQHDQWEEEGKALRQRLQKLTGERDTLAGQTVDLQGEVDSLSKERELLQKAREELRQQLEVLEQEAWRLRRVNVELQLQGDSAQGQKEEQQEELHLAVRERERLQEMLMGLEAKQSESLSELITLREALESSHLEGELLRQEQTEVTAALARAEQSIAELSSSENTLKTEVADLRAAAVKLSALNEALALDKVGLNQQLLQLEEENQSVCSRMEAAEQARNALQVDLAEAEKRREALWEKNTHLEAQLQKAEEAGAELQADLRDIQEEKEEIQKKLSESRHQQEAATTQLEQLHQEAKRQEEVLARAVQEKEALVREKAALEVRLQAVERDRQDLAEQLQGLSSAKELLESSLFEAQQQNSVIEVTKGQLEVQIQTVTQAKEVIQGEVRCLKLELDTERSQAEQERDAAARQLAQAEQEGKTALEQQKAAHEKEVNQLREKWEKERSWHQQELAKALESLEREKMELEMRLKEQQTEMEAIQAQREEERTQAESALCQMQLETEKERVSLLETLLQTQKELADASQQLERLRQDMKVQKLKEQETTGILQTQLQEAQRELKEAARQHRDDLAALQEESSSLLQDKMDLQKQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSSPGCSGSWSGYRQPWRQTEAREIEWREKAQDLALSLAQTKASVSSLQEVAMFLQASVLERDSEQQRLQDELELTRRALEKERLHSPGATSTAELGSRGEQGVQLGEVSGVEAEPSPDGMEKQSWRQRLEHLQQAVARLEIDRSRLQRHNVQLRSTLEQVERERRKLKREAMRAAQAGSLEISKATASSPTQQDGRGQKNSDAKCVAELQKEVVLLQAQLTLERKQKQDYITRSAQTSRELAGLHHSLSHSLLAVAQAPEATVLEAETRRLDESLTQSLTSPGPVLLHPSPSTTQAASR

SEQ ID NO: 852335 - protein, 2348 aa, Homo sapiens
MKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQEFFKGYLKGEHGRLLSLWREVVTFRRHFLEMKSATDRDLMELKAEHVRLSGSLLTCCLRLTVGAQSREPNGSGRMDGREPAQLLLLLAKTQELEKEAHERSQELIQLKSQGDLEKAELQDRVTELSALLTQSQKQNEDYEKMIKALRETVEILETNHTELMEHEASLSRNAQEEKLSLQQVIKDITQVMVEEGDNIAQGSGHENSLELDSSIFSQFDYQDADKALTLVRSVLTRRRQAVQDLRQQLAGCQEAVNLLQQQHDQWEEEGKALRQRLQKLTGERDTLAGQTVDLQGEVDSLSKERELLQKAREELRQQLEVLEQEAWRLRRVNVELQLQGDSAQGQKEEQQEELHLAVRERERLQEMLMGLEAKQSESLSELITLREALESSHLEGELLRQEQTEVTAALARAEQSIAELSSSENTLKTEVADLRAAAVKLSALNEALALDKVGLNQQLLQLEEENQSVCSRMEAAEQARNALQVDLAEAEKRREALWEKNTHLEAQLQKAEEAGAELQADLRDIQEEKEEIQKKLSESRHQQEAATTQLEQLHQEAKRQEEVLARAVQEKEALVREKAALEVRLQAVERDRQDLAEQLQGLSSAKELLESSLFEAQQQNSVIEVTKGQLEVQIQTVTQAKEVIQGEVRCLKLELDTERSQAEQERDAAARQLAQAEQEGKTALEQQKAAHEKEVNQLREKWEKERSWHQQELAKALESLEREKMELEMRLKEQQTEMEAIQAQREEERTQAESALCQMQLETEKERVSLLETLLQTQKELADASQQLERLRQDMKVQKLKEQETTGILQTQLQEAQRELKEAARQHRDDLAALQEESSSLLQDKMDLQKQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQDELELTRRALEKERLHSPGATSTAELGSRGEQGVQLGEVSGVEAEPSPDGMEKQSWRQRLEHLQQAVARLEIDRSRLQRHNVQLRSTLEQVERERRKLKREAMRAAQAGSLEISKATASSPTQQDGRGQKNSDAKCVAELQKEECS

SEQ ID NO: 852336 - protein, 1645 aa, Homo sapiens
MKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQEFFKGYLKGEHGRLLSLWREVVTFRRHFLEMKSATDRDLMELKAEHVRLSGSLLTCCLRLTVGAQSREPNGSGRMDGREPAQLLLLLAKTQELEKEAHERSQELIQLKSQGDLEKAELQDRVTELSALLTQSQKQNEDYEKMIKALRETVEILETNHTELMEHEASLSRNAQEEKLSLQQVIKDITQVMVEEGDNIAQGSGHENSLELDSSIFSQFDYQDADKALTLVRSVLTRRRQAVQDLRQQLAGCQEAVNLLQQQHDQWEEEGKALRQRLQKLTGERDTLAGQTVDLQGEVDSLSKERELLQKAREELRQQLEVLEQEAWRLRRVNVELQLQGDSAQGQKEEQQEELHLAVRERERLQEMLMGLEAKQSESLSELITLREALESSHLEGELLRQEQTEVTAALARAEQSIAELSSSENTLKTEVADLRAAAVKLSALNEALALDKVGLNQQLLQLEEENQSVCSRMEAAEQARNALQVDLAEAEKRREALWEKNTHLEAQLQKAEEAGAELQADLRDIQEEKEEIQKKLSESRHQQEAATTQLEQLHQEAKRQEEVLARAVQEKEALVREKAALEVRLQAVERDRQDLAEQLQGLSSAKELLESSLFEAQQQNSVIEVTKGQLEVQIQTVTQAKEVIQGEVRCLKLELDTERSQAEQERDAAARQLAQAEQEGKTALEQQKAAHEKEVNQLREKWEKERSWHQQELAKALESLEREKMELEMRLKEQQTEMEAIQAQREEERTQAESALCQMQLETEKERVSLLETLLQTQKELADASQQLERLRQDMKVQKLKEQETTGILQTQLQEAQRELKEAARQHRDDLAALQEESSSLLQDKMDLQKQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELPPSGPIQSSRVPC

SEQ ID NO: 852337 - protein, 1556 aa, Homo sapiens
MKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQEFFKGYLKGEHGRLLSLWREVVTFRRHFLEMKSATDRDLMELKAEHVRLSGSLLTCCLRLTVGAQSREPNGSGRMDGREPAQLLLLLAKTQELEKEAHERSQELIQLKSQGDLEKAELQDRVTELSALLTQSQKQNEDYEKMIKALRETVEILETNHTELMEHEASLSRNAQEEKLSLQQVIKDITQVMVEEGDNIAQGSGHENSLELDSSIFSQFDYQDADKALTLVRSVLTRRRQAVQDLRQQLAGCQEAVNLLQQQHDQWEEEGKALRQRLQKLTGERDTLAGQTVDLQGEVDSLSKERELLQKAREELRQQLEVLEQEAWRLRRVNVELQLQGDSAQGQKEEQQEELHLAVRERERLQEMLMGLEAKQSESLSELITLREALESSHLEGELLRQEQTEVTAALARAEQSIAELSSSENTLKTEVADLRAAAVKLSALNEALALDKVGLNQQLLQLEEENQSVCSRMEAAEQARNALQVDLAEAEKRREALWEKNTHLEAQLQKAEEAGAELQADLRDIQEEKEEIQKKLSESRHQQEAATTQLEQLHQEAKRQEEVLARAVQEKEALVREKAALEVRLQAVERDRQDLAEQLQGLSSAKELLESSLFEAQQQNSVIEVTKGQLEVQIQTVTQAKEVIQGEVRCLKLELDTERSQAEQERDAAARQLAQAEQEGKTALEQQKAAHEKEVNQLREKWEKERSWHQQELAKALESLEREKMELEMRLKEQQTEMEAIQAQREEERTQAESALCQMQLETEKERVSLLETLLQTQKELADASQQLERLRQDMKVQKLKEQETTGILQTQLQEAQRELKEAARQHRDDLAALQEESSSLLQDKMDLQKQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEEARRPEQARRPEQARRPEQARRPEQARRPEQAEL

SEQ ID NO: 852338 - protein, 329 aa, Homo sapiens [sequence omitted]

SEQ ID NO: 852339 - protein, 150 aa, Homo sapiens
MGHEQNQGAALLQMLPLLWLLPHSWAVPEAPTPMWPDDLQNHTFLHTVYCQDGSPSVGLSEAYDEDQLSFLPFFPNLFPRNNFPGGLAFALGPGKFLWALWGTFGGASKGRTKGGNGNGFPHGHHFDFEQESYWRSGIESMQDREGRTEL

SEQ ID NO: 852340 - protein, 131 aa, Homo sapiens [sequence omitted]

SEQ ID NO: 852341 - protein, 157 aa, Homo sapiens
MGHEQNQGAALLQMLPLLWLLPHSWAVPEAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLKPLEFGKPNTLVCFLSVISSHPC

SEQ ID NO: 852342 - protein, 131 aa, Homo sapiens [sequence omitted]

SEQ ID NO: 852343 - protein, 106 aa, Homo sapiens [sequence omitted]

SEQ ID NO: 852344 - protein, 139 aa, Homo sapiens
MGHEQNQGAALLQMLPLLWLLPHSWAVPEAPTPMWPDDLQNHTFLHTVYCQDGSPSVGLSEAYDEDQLFFFDFSQNTRVPRLPEFADWAQEQGDAPAILFDKEFCEWMIQQIGPKLDGLEFGKPNTLVCFLSVISSHPC

SEQ ID NO: 852345 - protein, 106 aa, Homo sapiens [sequence omitted]

SEQ ID NO: 852346 - protein, 106 aa, Homo sapiens [sequence omitted]

SEQ ID NO: 852347 - protein, 179 aa, Homo sapiens
DLRPPSRGGSWGSWVGWVGSSYLLCGKKVWVMNRTKELRCYRCYHFCGCYPTPGPSLKLLLQCGQMTCKTTHSCTQLNWQHHSVPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSGD

SEQ ID NO: 852348 - protein, 157 aa, Homo sapiens; identical to SEQ ID NO: 852341

SEQ ID NO: 852349 - protein, 71 aa, Homo sapiens
SVRCLEDPGSTCIVTHEIDRYTAIAYWVPRNALPSDLLENVLCGVAFGLGVLGIIVGIVLIIYFRKPCSGD

SEQ ID NO: 852350 - protein, 86 aa, Homo sapiens
DLRPPSRGGSWGSWVGWVGSSYLLCGKKVWVMNRTKELRCYRCYHFCGCYPTPGPSLKLLLQCGQMTCKTTHSCTQCEGDPHRVGQ

SEQ ID NO: 852351 - protein, 157 aa, Homo sapiens; identical to SEQ ID NO: 852341

SEQ ID NO: 852352 - protein, 142 aa, Homo sapiens
DLRPPSRGGSWGSWVGWVGSSYLLCGKKVWVMNRTKELRCYRCYHFCGCYPTPGPSLKLLLQCGQMTVGLSEAYDEDQLFFFDFSQNTRVPRLPEFADWAQEQGDAPAILFDKEFCEWMIQQIGPKLDGKIPVSRGQEFSGE

SEQ ID NO: 852353 - protein, 187 aa, Homo sapiens
VSCWLSDSCQELQRRGIILCSYGVTSPIAVFGRPGRLRNRRHFERRLVPMKWLKKCLDTAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLKPLEFGKPNTLVCFLSVISSHPC

SEQ ID NO: 852354 - protein, 106 aa, Homo sapiens [sequence omitted]

SEQ ID NO: 852355 - protein, 140 aa, Homo sapiens
DLRPPSRGGSWGSWVGWVGSSYLLCGKKVWVMNRTKELRCYRCYHFCGCYPTPGPSLKNTRVPRLPEFADWAQEQGDAPAILFDKEFCEWMIQQIGPKLDGKIPVSRGFPIAEVFTLKPLEFGKPNTLVCFLSVISSHPC

SEQ ID NO: 852356 - protein, 227 aa, Homo sapiens
MGHEQNQGAALLQMLPLLWLLPHSWAVPEAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRVNWQHHSVPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSGD

SEQ ID NO: 852357 - protein, 106 aa, Homo sapiens [sequence omitted]

SEQ ID NO: 852358 - protein, 106 aa, Homo sapiens [sequence omitted]

SEQ ID NO: 852359 - protein, 131 aa, Homo sapiens [sequence omitted]

SEQ ID NO: 852360 - protein, 157 aa, Homo sapiens; identical to SEQ ID NO: 852341

SEQ ID NO: 852361 - protein, 298 aa, Homo sapiens
MEGMDVDLDPELMQKFSCLGTTDKDVLISEFQRLLGFQLNPAGCAFFLDMTNWNLQAAIGAYYDFESPNISVPSMSFVEDVTIGEGESIPPDTQFVKTWRIQNSGAEAWPPGVCLKYVGGDQFGHVNMVMVRSLEPQEIADVSVQMCSPSRAGMYQGQWRMCTATGLYYGDVIWVILSVEVGGLLGVTQQLSSFETEFNTQPHRKVEGNFNPFASPQKNRQSDENNLKDPGGSEFDSISKNTWAPAPDTWAPAPDQTEQDQNRLSQNSVNLSPSSHANNLSVVTYSKGLHGPYPFGQS

SEQ ID NO: 852362 - protein, 232 aa, Homo sapiens
MEGMDVDLDPELMQKFSCLGTTDKDVLISEFQRLLGFQLNPAGCAFFLDMTNWNLQAAIGAYYDFESPNISVPSMSFVEDVTIGEGESIPPDTQFVKTWRIQNSDVIWVILSVEVGGLLGVTQQLSSFETEFNTQPHRKVEGNFNPFASPQKNRQSDENNLKDPGGSEFDSISKNTWAPAPDTWAPAPDQTEQDQNRLSQNSVNLSPSSHANNLSVVTYSKGLHGPYPFGQS

SEQ ID NO: 852363 - protein, 289 aa, Homo sapiens
MEGMDVDLDPELMQKFSCLGTTDKDVLISEFQRLLGFQLNPAGCAFFLDMTNWNLQAAIGAYYDFESPNISVPSMSFVEDVTIGEGESIPPDTQFVKTWRIQNSGAEAWPPGVCLKYVGGDQFGHVNMVMVRSLEPQEIADVSVQMCSPSRAGMYQGQWRMCTATGLYYGDVIWVILSVEVGGLLGVTQQLSSFETEFNTQPHRKVEGNFNPFASPQKNRQSDENNLKDPGGSEFDSISKNTWAPAPDTWAPAPDQTEQDQNRLSQNSVNLSPSSHANNLSVVTYSKCT

SEQ ID NO: 852364 - protein, 297 aa, Homo sapiens
MEGMDVDLDPELMQKFSCLGTTDKDVLISEFQRLLGFQLNPAGCAFFLDMTNWNLQAAIGAYYDFESPNISVPSMSFVEDVTIGEGESIPPDTQFVKTWRIQNSGAEAWPPGVCLKYVGGDQFGHVNMVMVRSLEPQEIADVSVQMCSPSRAGMYQGQWRMCTATGLYYGDVIWVILSVEVGGLLGVTQQLSSFETEFNTQPHRKVEGNFNPFASPQKNRQSDENNLKDPGGSEFDSISKNTWAPAPDTWAPAPDQTEQDQNRLSQNSVNLSPSSHANNLSVVTYSKSSCRAFCIWS

SEQ ID NO: 852365 - protein, 145 aa, Homo sapiens [sequence omitted]

SEQ ID NO: 852366 - protein, 62 aa, Homo sapiens
MEGMDVDLDPELMQKFSCLGTTDKDVLISEFQRLLGFQLNPAGCAVLDDFLDLRILFHLFRG

SEQ ID NO: 852367 - protein, 224 aa, Homo sapiens
MSFVEDVTIGEGESIPPDTQFVKTWRIQNSGAEAWPPGVCLKYVGGDQFGHVNMVMVRSLEPQEIADVSVQMCSPSRAGMYQGQWRMCTATGLYYGDVIWVILSVEVGGLLGVTQQLSSFETEFNTQPHRKVEGNFNPFASPQKNRQSDENNLKDPGGSEFDSISKNTWAPAPDTWAPAPDQTEQDQNRLSQNSVNLSPSSHANNLSVVTYSKGLHGPYPFGQS

SEQ ID NO: 852368 - protein, 298 aa, Homo sapiens; identical to SEQ ID NO: 852361

SEQ ID NO: 852369 - protein, 117 aa, Homo sapiens
MEGMDVDLDPELMQKFSCLGTTDKDVLISEFQRLLGFQLNPAGCAFFLDMTNWNLQAAIGAYYDFESPNISVPSMSFVEDVTIGEGESIPPDTQFVKTWRIQNSVTLLGTREEWSQD

SEQ ID NO: 852370 - protein, 117 aa, Homo sapiens; identical to SEQ ID NO: 852369

SEQ ID NO: 852371 - protein, 324 aa, Homo sapiens
MAAAAPGNGRASAPRLLLLFLVPLLWAPAAVRAGPDEDLSHRNKEPPAPAQQLQPQPVAVQGPEPARVEKIFTPAAPVHTNKEDPATQTNLGFIHAFVAAISVIIVSELGDKTFFIAAIMAMRYNRLTVLAGAMLALGLMTCLSVLFGYATTVIPRVYTYYVSTVLFAIFGIRMLREGLKMSPDEGQEELEEVQAELKKKDEEFQRTKLLNGPGDVETGTSITVPQKKWLHFISPIFVQALTLTFLAEWGDRSQLTTIVLAAREDPYGVAVGGTVGHCLCTGLAVIGGRMIAQKISVRTVTIIGGIVFLAFAFSALFISPDSGF

SEQ ID NO: 852372 - protein, 324 aa, Homo sapiens; identical to SEQ ID NO: 852371

SEQ ID NO: 852373 - protein, 302 aa, Homo sapiens
MAAAAPGNGRASAPRLLLLFLVPLLWAPAAVRAGPDEDLSHRNKEPPAPAQQLQPQPVAVQGPEPARVEKIFTPAAPVHTNKEDPATQTNLGFIHAFVAAISVIIVSELGDKTFFIAAIMAMRYNRLTVLAGAMLALGLMTCLSVLFGYATTVIPRVYTYYVSTVLFAIFGIRMLREGLKMSPDEGQEELEEVQAELKKKDEEFQRTKLLNGPGDVETGTSITVPQKKWLHFISPIFVQALTLTFLAEWGDRSQLTTIVLAAREDPYGVAVGGTVGHCLCTGLAVIGGRMIAQKISVRTGKS

SEQ ID NO: 852374 - protein, 268 aa, Homo sapiens
MAAAAPGNGRASAPRLLLLFLVPLLWAPAAVRAGPDEDLSHRNKEPPAPAQQLQPQPVAVQGPEPARVEKIFTPAAPVHTNKEDPATQTNLGFIHAFVAAISVIIVSELGDKTFFIAAIMAMRYNRLTVLAGAMLALGLMTCLSVLFGYATTVIPRVYTYYVSTVLFAIFGIRMLREGLKMSPDEGQEELEEVQAELKKKDEEFQRTKLLNGPGDVETGTSITVPQKKWLHFISPIFVQALTLTFLAEWGDRSQLTTIVLAAREVSDI

SEQ ID NO: 852375 - protein, 324 aa, Homo sapiens; identical to SEQ ID NO: 852371

SEQ ID NO: 852376 - protein, 285 aa, Homo sapiens
MAAAAPGNGRASAPRLLLLFLVPLLWAPAAKIFTPAAPVHTNKEDPATQTNLGFIHAFVAAISVIIVSELGDKTFFIAAIMAMRYNRLTVLAGAMLALGLMTCLSVLFGYATTVIPRVYTYYVSTVLFAIFGIRMLREGLKMSPDEGQEELEEVQAELKKKDEEFQRTKLLNGPGDVETGTSITVPQKKWLHFISPIFVQALTLTFLAEWGDRSQLTTIVLAAREDPYGVAVGGTVGHCLCTGLAVIGGRMIAQKISVRTVTIIGGIVFLAFAFSALFISPDSGF

SEQ ID NO: 852377 - protein, 324 aa, Homo sapiens; identical to SEQ ID NO: 852371

SEQ ID NO: 852378 - protein, 268 aa, Homo sapiens; identical to SEQ ID NO: 852374

SEQ ID NO: 852379 - protein, 161 aa, Homo sapiens
MAAAAPGNGRASAPRLLLLFLVPLLWAPAAVRAGPDEDLSHRNKEPPAPAQQLQPQPVAVQGPEPARVEKIFTPAAPVHTNKEDPATQTNLGFIHAFVAAISVIIVSELGDKTFFIAAIMAMRYNRLTVLAGAMLALGLMTCLSETGFRHVDQWSQAPGLK

SEQ ID NO: 852380 - protein, 129 aa, Homo sapiens
MAAAAPGNGRASAPRLLLLFLVPLLWAPAAVRAGPDEDLSHRNKEPPAPAQQLQPQPVAVQGPEPARVEDPYGVAVGGTVGHCLCTGLAVIGGRMIAQKISVRTVTIIGGIVFLAFAFSALFISPDSGF

SEQ ID NO: 852381 - protein, 324 aa, Homo sapiens; identical to SEQ ID NO: 852371

SEQ ID NO: 852382 - protein, 324 aa, Homo sapiens; identical to SEQ ID NO: 852371

SEQ ID NO: 852383 - protein, 268 aa, Homo sapiens; identical to SEQ ID NO: 852374

SEQ ID NO: 852384 - protein, 257 aa, Homo sapiens [sequence omitted]

SEQ ID NO: 852385 - protein, 321 aa, Homo sapiens
MAAAAPGNGRASAPRLLLLFLVPLLWAPAAVRAGPDEDLSHRNKEPPAPAQQLQPQPVAVQGPEPARVEKIFTPAAPVHTNKEDPATQTNLGFIHAFVAAISVIIVSELGDKTFFIAAIMAMRYNRLTVLAGAMLALGLMTCLSVLFGYATTVIPRVYTYYVSTVLFAIFGIRMLREGLKMSPDEGQEELEEVQAELKKKDEEFQRTKLLNGPGDVETGTSITVPQKKWLHFISPIFVQALTLTFLAEWGDRSQLTTIVLAAREDPYGVAVGGTVGHCLCTGLAVIGGRMIAQKISVRTGSFSPWLILHACSDGKGHLERN

SEQ ID NO: 852386 - protein, 268 aa, Homo sapiens; identical to SEQ ID NO: 852374

SEQ ID NO: 852387 - protein, 111 aa, Homo sapiens
MAAAAPGNGRASAPRLLLLFLVPLLWAPAAVRAGPDEDLSHRNKEPPAAPSTRLQAFESAALRRPRLGEGSPAPAPGVEGGRLRCFPVRPGLARSFRERERESPRGARYKR

SEQ ID NO: 852388 - protein, 562 aa, Homo sapiens
MDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLGRPKPECEGYDPNALYCICRQPHNNRFMICCDRCEEWFHGDCVGISEARGRLLERNGEDYICPNCTILQVQDETHSETADQQEAKWRPGDADGTDCTSIGTIEQKSSEDQGIKGRIEKAANPSGKKKLKIFQPVIEAPGASKCIGPGCCHVAQPDSVYCSNDCILKHAAATMKFLSSGKEQKPKPKEKMKMKPEKPSLPKCGAQAGIKISSVHKRPAPEKKETTVKKAVVVPARSEALGKEAACESSTPSWASDHNYNAVKPEKTAAPSPSLLYKCMYHLGVGLLDPSRSFWIAIPWACPGLGVAALC

SEQ ID NO: 852389 - protein, 111 aa, Homo sapiens
GAGGQAHRRPPLSTSRDSKRAREREPMTNEAPPRGGGADGLPEARNLSFRTCAELPSRRPRTTGWRQSQKASALWQDGCCGGVGARKSGTGMATSTLSRRRRSQLFSCRLR

SEQ ID NO: 852390 - protein, 1225 aa, Homo sapiens
MDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLGRPKPECEGYDPNALYCICRQPHNNRFMICCDRCEEWFHGDCVGISEARGRLLERNGEDYICPNCTILQVQDETHSETADQQEAKWRPGDADGTDCTSIGTIEQKSSEDQGIKGRIEKAANPSGKKKLKIFQPGPGPVPTQLPVLWQVLEIAVSRSISAFTLLHCISCKVIEAPGASKCIGPGCCHVAQPDSVYCSNDCILKHAAATMKFLSSGKEQKPKPKEKMKMKPEKPSLPKCGAQAGIKISSVHKRPAPEKKETTVKKAVVVPARSEALGKEAACESSTPSWASDHNYNAVKPEKTAAPSPSLLYKSTKEDRRSEEKAAAMAASKKTAPPGSAVGKQPAPRNLVPKKSSFANVAAATPAIKKPPSGFKGTIPKRPWLSATPSSGASAARQAGPAPAAATAASKKFPGSAALVGAVRKPVVPSVPMASPAPGRLGAMSAAPSQPNSQIRQNIRRSLKEILWKRVNDSDDLIMTENEVGKIALHIEKEMFNLFQVTDNRYKSKYRSIMFNLKDPKNQGLFHRVLREEISLAKLVRLKPEELVSKELSTWKERPARSVMESRTKLHNESKKTAPRQEAIPDLEDSPPVSDSEEQQESARAVPEKSTAPLLDVFSSMLKDTTSQHRAHLFDLNCKICTGQVPSAEDEPAPKKQKLSASVKKEDLKSKHDSSAPDPAPDSADEVMPEAVPEVASEPGLESASHPNVDRTYFPGPPGDGHPEPSPLEDLSPCPASCGSGVVTTVTVSGRDPRTAPSSSCTAVASAASRPDSTHMVEARQDVPKPVLTSVMVPKSILAKPSSSPDPRYLSVPPSPNISTSESRSPPEGDTTLFLSRLSTIWKGFINMQSVAKFVTKAYPVSGCFDYLSEDLPDTIHIGGRIAPKTVWDYVGKLKSSVSKELCLIRFHPATEEEEVAYISLYSYFSSRGRFGVVANNNRHVKDLYLIPLSAQDPVPSKLLPFEGPGKRRLSGWR

SEQ ID NO: 852391 - protein, 544 aa, Homo sapiens
MDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLGRPKPECEGYDPNALYCICRQPHNNRFMICCDRCEEWFHGDCVGISEARGRLLERNGEDYICPNCTILQVQDETHSETADQQEAKWRPGDADGTDCTSIGTIEQKSSEDQGIKGRIEKAANPSGKKKLKIFQPVIEAPGASKCIGPGCCHVAQPDSVYCSNDCILKHAAATMKFLSSGKEQKPKPKEKMKMKPEKPSLPKCGAQAGIKISSVHKRPAPEKKETTVKKAVVVPARSEALGKEAACESSTPSWASDHNYNAVKPEKTAAPSPSLLYKCSGKYSYSLHPSLIA

SEQ ID NO: 852392 - protein, 562 aa, Homo sapiens; identical to SEQ ID NO: 852388

SEQ ID NO: 852393 - protein, 1189 aa, Homo sapiens
MDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLGRPKPECEGYDPNALYCICRQPHNNRFMICCDRCEEWFHGDCVGISEARGRLLERNGEDYICPNCTILQVQDETHSETADQQEAKWRPGDADGTDCTSIGTIEQKSSEDQGIKGRIEKAANPSGKKKLKIFQPVIEAPGASKCIGPGCCHVAQPDSVYCSNDCILKHAAATMKFLSSGKEQKPKPKEKMKMKPEKPSLPKCGAQAGIKISSVHKRPAPEKKETTVKKAVVVPARSEALGKEAACESSTPSWASDHNYNAVKPEKTAAPSPSLLYKSTKEDRRSEEKAAAMAASKKTAPPGSAVGKQPAPRNLVPKKSSFANVAAATPAIKKPPSGFKGTIPKRPWLSATPSSGASAARQAGPAPAAATAASKKFPGSAALVGAVRKPVVPSVPMASPAPGRLGAMSAAPSQPNSQIRQNIRRSLKEILWKRVNDSDDLIMTENEVGKIALHIEKEMFNLFQVTDNRYKSKYRSIMFNLKDPKNQGLFHRVLREEISLAKLVRLKPEELVSKELSTWKERPARSVMESRTKLHNESKKTAPRQEAIPDLEDSPPVSDSEEQQESARAVPEKSTAPLLDVFSSMLKDTTSQHRAHLFDLNCKICTGQVPSAEDEPAPKKQKLSASVKKEDLKSKHDSSAPDPAPDSADEVMPEAVPEVASEPGLESASHPNVDRTYFPGPPGDGHPEPSPLEDLSPCPASCGSGVVTTVTVSGRDPRTAPSSSCTAVASAASRPDSTHMVEARQDVPKPVLTSVMVPKSILAKPSSSPDPRYLSVPPSPNISTSESRSPPEGDTTLFLSRLSTIWKGFINMQSVAKFVTKAYPVSGCFDYLSEDLPDTIHIGGRIAPKTVWDYVGKLKSSVSKELCLIRFHPATEEEEVAYISLYSYFSSRGRFGVVANNNRHVKDLYLIPLSAQDPVPSKLLPFEGPGKRRLSGWR

SEQ ID NO: 852394 - protein, 1186 aa, Homo sapiens
MDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLGRPKPECEGYDPNALYCICRQPHNNRFMICCDRCEEWFHGDCVGISEARGRLLERNGEDYICPNCTILQVQDETHSETADQQEAKWRPGDADGTDCTSIGTIEQKSSEDQGIKGRIEKAANPSGKKKLKIFQPVIEAPGASKCIGPGCCHVAQPDSVYCSNDCILKHAAATMKFLSSGKEQKPKPKEKMKMKPEKPSLPKCGAQAGIKISSVHKRPAPEKKETTVKKAVVVPARSEALGKEAACESSTPSWASDHNYNAVKPEKTAAPSPSLLYKSTKEDRRSEEKAAAMAASKKTAPPGSAVGKQPAPRNLVPKKSSFANVAAATPAIKKPPSGFKGTIPKRPWLSATPSSGASAARQAGPAPAAATAASKKFPGSAALVGAVRKPVVPSVPMASPAPGRLGAMSAAPSQPNSQIRQNIRRSLKEILWKRVNDSDDLIMTENEVGKIALHIEKEMFNLFQVTDNRYKSKYRSIMFNLKDPKNQGLFHRVLREEISLAKLVRLKPEELVSKELSTWKERPARSVMESRTKLHNESKKTAPRQEAIPDLEDSPPVSDSEEQQESARAVPEKSTAPLLDVFSSMLKDTTSQHRAHLFDLNCKICTGQVPSAEDEPAPKKQKLSASVKKEDLKSKHDSSAPDPAPDSADEVMPEAVPEVASEPGLESASHPNVDRTYFPGPPGDGHPEPSPLEDLSPCPASCGSGVVTTVTVSGRDPRTAPSSSCTAVASAASRPDSTHMVEARQDVPKPVLTSVMVPKSILAKPSSSPDPRYLSVPPSPNISTSESRSPPEGDTTLFLSRLSTIWKGFINMQSVAKFVTKAYPVSGCFDYLSEDLPDTIHIGGRIAPKTVWDYVGKLKSSVSKELCLIRFHPATEEEEVAYISLYSYFSSRGRFGVVANNNRHVKDLYLIPLSAQDPVPSKLLPFEGPVVSHTS

SEQ ID NO: 852395 - protein, 792 aa, Homo sapiens
MDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLGRPKPECEGYDPNALYCICRQPHNNRFMICCDRCEEWFHGDCVGISEARGRLLERNGEDYICPNCTILQVQDETHSETADQQEAKWRPGDADGTDCTSIGTIEQKSSEDQGIKGRIEKAANPSGKKKLKIFQPVIEAPGASKCIGPGCCHVAQPDSVYCSNDCILKHAAATMKFLSSGKEQKPKPKEKMKMKPEKPSLPKCGAQAGIKISSVHKRPAPEKKETTVKKAVVVPARSEALGKEAACESSTPSWASDHNYNAVKPEKTAAPSPSLLYKSTKEDRRSEEKAAAMAASKKTAPPGSAVGKQPAPRNLVPKKSSFANVAAATPAIKKPPSGFKGTIPKRPWLSATPSSGASAARQAGPAPAAATAASKKFPGSAALVGAVRKPVVPSVPMASPAPGRLGAMSAAPSQPNSQIRQNIRRSLKEILWKRVNDSDDLIMTENEVGKIALHIEKEMFNLFQVTDNRYKSKYRSIMFNLKDPKNQVCAWCRCIGVFLFCSLGAKGINQYFEMFVSFPGKLRRFFLLCDPSAAHVLLHWR

SEQ ID NO: 852396 - protein, 646 aa, Homo sapiens
MAASKKTAPPGSAVGKQPAPRNLVPKKSSFANVAAATPAIKKPPSGFKGTIPKRPWLSATPSSGASAARQAGPAPAAATAASKKFPGSAALVGAVRKPVVPSVPMASPAPGRLGAMSAAPSQPNSQIRQNIRRSLKEILWKRVNDSDDLIMTENEVGKIALHIEKEMFNLFQVTDNRYKSKYRSIMFNLKDPKNQGLFHRVLREEISLAKLVRLKPEELVSKELSTWKERPARSVMESRTKLHNESKKTAPRQEAIPDLEDSPPVSDSEEQQESARAVPEKSTAPLLDVFSSMLKDTTSQHRAHLFDLNCKICTGQVPSAEDEPAPKKQKLSASVKKEDLKSKHDSSAPDPAPDSADEVMPEAVPEVASEPGLESASHPNVDRTYFPGPPGDGHPEPSPLEDLSPCPASCGSGVVTTVTVSGRDPRTAPSSSCTAVASAASRPDSTHMVEARQDVPKPVLTSVMVPKSILAKPSSSPDPRYLSVPPSPNISTSESRSPPEGDTTLFLSRLSTIWKGFINMQSVAKFVTKAYPVSGCFDYLSEDLPDTIHIGGRIAPKTVWDYVGKLKSSVSKELCLIRFHPATEEEEVAYISLYSYFSSRGRFGVVANNNRHVKDLYLIPLSAQDPVPSKLLPFEGPGKRRLSGWR

SEQ ID NO: 852397 - protein, 562 aa, Homo sapiens; identical to SEQ ID NO: 852388

SEQ ID NO: 852398 - protein, 138 aa, Homo sapiens
MDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTGERRGWTR

SEQ ID NO: 852399 - protein, 562 aa, Homo sapiens; identical to SEQ ID NO: 852388

SEQ ID NO: 852400 - protein, 562 aa, Homo sapiens; identical to SEQ ID NO: 852388

SEQ ID NO: 852401 - protein, 281 aa, Homo sapiens [sequence omitted]

SEQ ID NO: 852402 - protein, 1327 aa, Homo sapiens
MDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLGRPKPECEGYDPNALYCICRQPHNNRFMICCDRCEEWFHGDCVGISEARGRLLERNGEDYICPNCTILQVQDETHSETADQQEAKWRPGDADGTDCTSIGTIEQKSSEDQGIKGRIEKAANPSGKKKLKIFQPVIEAPGASKCIGPGCCHVAQPDSVYCSNDCILKHAAATMKFLSSGKEQKPKPKEKMKMKPEKPSLPKCGAQAGIKISSVHKRPAPEKKETTVKKAVVVPARSEALGKEAACESSTPSWASDHNYNAVKPEKTAAPSPSLLYKSTKEDRRSEEKAAAMAASKKTAPPGSAVGKQPAPRNLVPKKSSFANVAAATPAIKKPPSGFKGTIPKRPWLSATPSSGASAARQAGPAPAAATAASKKFPGSAALVGAVRKPVVPSVPMASPAPGRLGAMSAAPSQPNSQIRQNIRRSLKEILWKRVNDSDDLIMTENEVGKIALHIEKEMFNLFQVTDNRYKSKYRSIMFNLKDPKNQGLFHRVLREEISLAKLVRLKPEELVSKELSTWKERPARSVMESRTKLHNESKKTAPRQEAIPDLEDSPPVSDSEEQQESARAVPEKSTAPLLDVFSSMLKDTTSQHRAHLFDLNCKICTGQVPSAEDEPAPKKQKLSASVKKEDLKSKHDSSAPDPAPDSADEVMPEAVPEVASEPGLESASHPNVDRTYFPGPPGDGHPEPSPLEDLSPCPASCGSGVVTTVTVSGRDPRTAPSSSCTAVASAASRPDSTHMVEARQDVPKPVLTSVMVPKSILAKPSSSPDPRYLSVPPSPNISTSESRSPPEGDTTLFLSRLSTIWKGFINMQSVAKFVTKAYPVSGCFDYLSEDLPDTIHIGGRIAPKTVWDYVGKLKSSVSKELCLIRFHPATEEEEVAYISLYSYFSSRGRFGVVANNNRHVKDLYLIPLSAQDPVPSKLLPFEGPGLESPRPNIILGLVICQKIKRPANSGELDKMDEKRTRLQPEEADVPAYPKVATVPQSEKKPSKYPLCSADAAVSTTPPGSPPPPPPLPEPPVLKVLSSLKPAAPSPATAATTAAAASTAASSTASSASKTASPLEHILQTLFGKKKS

SEQ ID NO: 852403 - protein, 120 aa, Homo sapiens
LPADGAAGDCDQLNTKLQLPVLQRHKRPAPEKKETTVKKAVVVPARSEALGKEAACESSTPSWASDHNYNAVKPEKTAAPSPSLLYKCMYHLGVGLLDPSRSFWIAIPWACPGLGVAALC

SEQ ID NO: 852404 - protein, 473 aa, Homo sapiens [sequence omitted]

SEQ ID NO: 852405 - protein, 354 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGLQSESLVYTSILKKYPYSVLSRQHNEKWD

SEQ ID NO: 852406 - protein, 105 aa, Homo sapiens
SFALHPEEPVFLAQTNGNYLALFSTVWPYRMSRRRRYEGHKVEGYSVGCECSPGGDLLVTGSADGRVLMYSFRTASRACTLQGHTQACVGTTYHPMLPSALPTQI

SEQ ID NO: 852407 - protein, 62 aa, Homo sapiens
RARYPRPATGRPRVVIVAEVALVACGEEEVASWIVVVPVECSEVAVVETEVAATTGGDPTRV

SEQ ID NO: 852408 - protein, 687 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNRGFSSASYLKVHVKTHHGVPLPQVSRHQEPILNGGAAFHCARTYGNKEGQKCSHQDPIESSDSYGDLSDASDLKTPEKQSANGSFSCDMAVPKNKMESDGEKKYPCPECGSFFRSKSYLNKHIQKVHVRALGGPLGDLGPALGSPFSPQQNMSLLESFGFQIVQSAFASSLVDPEVDQQPMGPEGK

SEQ ID NO: 852409 - protein, 537 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNRGLQAPGAHPEWGSSVPLRQDLWQQRRPEMLTSGSD

SEQ ID NO: 852410 - protein, 656 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCKAPKPEGFLPPPFPPPGGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 852411 - protein, 656 aa, Homo sapiens; identical to SEQ ID NO: 852410

SEQ ID NO: 852412 - protein, 354 aa, Homo sapiens; identical to SEQ ID NO: 852405

SEQ ID NO: 852413 - protein, 354 aa, Homo sapiens; identical to SEQ ID NO: 852405

SEQ ID NO: 852414 - protein, 656 aa, Homo sapiens; identical to SEQ ID NO: 852410

SEQ ID NO: 852415 - protein, 656 aa, Homo sapiens; identical to SEQ ID NO: 852410

SEQ ID NO: 852416 - protein, 656 aa, Homo sapiens; identical to SEQ ID NO: 852410

SEQ ID NO: 852417 - protein, 656 aa, Homo sapiens; identical to SEQ ID NO: 852410

SEQ ID NO: 852418 - protein, 656 aa, Homo sapiens; identical to SEQ ID NO: 852410

SEQ ID NO: 852419 - protein, 669 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPSIGDFCCDVIVCRGCGNQNFAWRTECNQCKAPKPEGFLPPPFPPPGGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 852420 - protein, 583 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCKAPKPEGFLPPPFPPPGRCRFHECPLSFLVLNLFSYLWAW

SEQ ID NO: 852421 - protein, 534 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPYVLVLAN

SEQ ID NO: 852422 - protein, 639 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 852423 - protein, 652 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPSIGDFCCDVIVCRGCGNQNFAWRTECNQCGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 852424 - protein, 534 aa, Homo sapiens; identical to SEQ ID NO: 852421

SEQ ID NO: 852425 - protein, 583 aa, Homo sapiens; identical to SEQ ID NO: 852420

SEQ ID NO: 852426 - protein, 548 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCGPLDL

SEQ ID NO: 852427 - protein, 713 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNREGQKCSHQDPIESSDSYGDLSDASDLKTPEKQSANGSFSCDMAVPKNKMESDGEKKYPCPECGSFFRSKSYLNKHIQKVHVRALGGPLGDLGPALGSPFSPQQNMSLLESFGFQIVQSAFASSLVDPEVDQQPMGPEGK

SEQ ID NO: 852428 - protein, 609 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQVWVGSSSGLPPLEPLPSDLPSWDFAQPALWRSSHSVPDTAFSLSLKKSFPALENLGPAHSSNTLFCPAPPGYLRQGWTTPEGSRAFTQWPVG

SEQ ID NO: 852429 - protein, 354 aa, Homo sapiens; identical to SEQ ID NO: 852405

SEQ ID NO: 852430 - protein, 759 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNRGFSSASYLKVHVKTHHGVPLPQVSRHQEPILNGGAAFHCARTYGNKEGQKCSHQDPIESSDSYGDLSDASDLKTPEKQSANGSFSCDMAVPKNKMESDGEKKYPCPECGSFFRSKSYLNKHIQKVHVRALGGPLGDLGPALGSPFSPQQNMSLLESFGFQIVQSAFASSLVDPEVDQQPMGPEGK

SEQ ID NO: 852431 - protein, 354 aa, Homo sapiens; identical to SEQ ID NO: 852405

SEQ ID NO: 852432 - protein, 419 aa, Homo sapiens
MDRVTTVIPRYLGATPCSQSLHLHPTLLPAIPLHSRLVMIRAVTLSRTPMGNRAAMDSRVAMVNKAAMGSSLPLVTHPKLDPTAKLQVNIANRAAATGSRGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCKAPKPEGFLPPPFPPPGGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 852433 - protein, 713 aa, Homo sapiens; identical to SEQ ID NO: 852427

SEQ ID NO: 852434 - protein, 354 aa, Homo sapiens; identical to SEQ ID NO: 852405

SEQ ID NO: 852435 - protein, 325 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMG

SEQ ID NO: 852436 - protein, 582 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQVWVGSSSGLPPLEPLPSDLPSWDFAQPALWRSSHSVPDTAFSLSLKKSFPALENLGPAHSSNTQI

SEQ ID NO: 852437 - protein, 354 aa, Homo sapiens; identical to SEQ ID NO: 852405

SEQ ID NO: 852438 - protein, 638 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCKAPKPEGFLPPPFPPPGGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 852439 - protein, 478 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQNVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 852440 - protein, 432 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSGQIQLWQFLLELLSDSSNSSCITWEGTNGEFKMTDPDEVARRWGQRKSKPNMNYDKLSRALRYYYDKNIMTKVHGKSYAYKFDFHGIAQALQPHPTESSLYKYPSDISYMGSYHAHQQKVNFVAPHPPALPVTSSSFFAAPNPYWNSPTGGIYPNTRLPTSHMPSH

SEQ ID NO: 852441 - protein, 360 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQIAIAPNGALQLASPGTDGVQGLQTLTMTNSGSTQQGTTILQYAQTSDGQQILVPSNQVVVQTASGDMPTYQIRTTPSATSLPQTVVMTSPVTLTSQ

SEQ ID NO: 852442 - protein, 244 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGHTLRGVRARSF

SEQ ID NO: 852443 - protein, 262 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDCYSHHHPGLLMQLSLHMALSLLIQPMGSSQQPCTYKTAGCNKPSETSQPQSSNGVTPT

SEQ ID NO: 852444 - protein, 537 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQVWVGSSSGLPPLEPLPSDLPSWDFAQPALWRSSHSVPDTAFSLSLKKSFPALENLGPAHSSNTLFCPAPPGYLRQGWTTPEGSRAFTQWPVG

SEQ ID NO: 852445 - protein, 126 aa, Homo sapiens
RGPGKRGSPKGPGPRTLGEEFPQVEAGKCPIRVNTWVVKTSATPGRPQSLKASSRHPFRPRVVIVAEVALVACGEEEVASWIVVVPVECSEVAVVETEVASVVAGAWTEVALVEEDEVALGGPLDL

SEQ ID NO: 852446 - protein, 125 aa, Homo sapiens
CVALEDPAHPLGQQSSLGNESSYGQQPPTSYPPQTGSYSQAPSQYSQQSSSYGQQSEKPYQCDFKDCERRFSRSDQLKRHQRRHTGVKPFQCKTCQRKFSRSDHLKTHTRTHTGKTSEKPFSCRW

SEQ ID NO: 852447 - protein, 641 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNREGQKCSHQDPIESSDSYGDLSDASDLKTPEKQSANGSFSCDMAVPKNKMESDGEKKYPCPECGSFFRSKSYLNKHIQKVHVRALGGPLGDLGPALGSPFSPQQNMSLLESFGFQIVQSAFASSLVDPEVDQQPMGPEGK

SEQ ID NO: 852448 - protein, 656 aa, Homo sapiens; identical to SEQ ID NO: 852410

SEQ ID NO: 852449 - protein, 354 aa, Homo sapiens; identical to SEQ ID NO: 852405

SEQ ID NO: 852450 - protein, 656 aa, Homo sapiens; identical to SEQ ID NO: 852410

SEQ ID NO: 852451 - protein, 656 aa, Homo sapiens; identical to SEQ ID NO: 852410

SEQ ID NO: 852452 - protein, 317 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRTHG

SEQ ID NO: 852453 - protein, 656 aa, Homo sapiens; identical to SEQ ID NO: 852410

SEQ ID NO: 852454 - protein, 656 aa, Homo sapiens; identical to SEQ ID NO: 852410

SEQ ID NO: 852455 - protein, 639 aa, Homo sapiens; identical to SEQ ID NO: 852422

SEQ ID NO: 852456 - protein, 652 aa, Homo sapiens; identical to SEQ ID NO: 852423

SEQ ID NO: 852457 - protein, 656 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCENQSFQWRTECNQCKAPKPEGFLPPPFPPPGGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 852458 - protein, 632 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 852459 - protein, 534 aa, Homo sapiens; identical to SEQ ID NO: 852421

SEQ ID NO: 852460 - protein, 583 aa, Homo sapiens; identical to SEQ ID NO: 852420

SEQ ID NO: 852461 - protein, 548 aa, Homo sapiens; identical to SEQ ID NO: 852426

SEQ ID NO: 852462 - protein, 609 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNRGLQAPGAHPEWGSSVPLRQDLWQQRRPEMLTSGSD

SEQ ID NO: 852463 - protein, 634 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPSIGDFCCDVIVCRGCGNQNFAWRTECNQCGDRGRGGPGGMRGGRGGLMDRGGPGGMFRGGRGGDRGGFRGGRGMDRGGFGGGRRGGPGGPPGPLMEQMGSNIMSSLL

SEQ ID NO: 852464 - protein, 407 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLGPLDL

SEQ ID NO: 852465 - protein, 609 aa, Homo sapiens; identical to SEQ ID NO: 852428

SEQ ID NO: 852466 - protein, 594 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNRGNLPTVSSLPEDGPERVWEA

SEQ ID NO: 852467 - protein, 325 aa, Homo sapiens; identical to SEQ ID NO: 852435

SEQ ID NO: 852468 - protein, 601 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTSSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCKAPKPEGFLPPPFPPPGGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 852469 - protein, 477 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSPPLGGAQTISKNTEQRPQPDPYQILGPTSSRLANPGSSGQIQLWQFLLELLSDSSNSSCITWEGTNGEFKMTDPDEVARRWGQRKSKPNMNYDKLSRALRYYYDKNIMTKVHGKSYAYKFDFHGIAQALQPHPTESSLYKYPSDISYMASYHAHQQKVNFVPPHPSSMPVTSSSFFGAASQYWTSPTGGIYPNPNVPRHPNTHVPSHLGSYY

SEQ ID NO: 852470 - protein, 334 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSEKPYQCDFKDCERRFSRSDQLKRHQRRHTGVKPFQCKTCQRKFSRSDHLKTHTRTHTGKTSEKPFSCRW

SEQ ID NO: 852471 - protein, 297 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQHRAGDWQCPNPSIGDFCCDVIVCRGCGNQNFAWENQSCKPVGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 852472 - protein, 214 aa, Homo sapiens
MSDLEDDETPQLSAHALAALQEFYAEQKQQIEPGEDDKYNIGIIEENWQLSQFWYSQETALQLAQEAIAAVGEGGRIACVSAPSVYQKLRELCRENFSIYIFEYDKRFAMYGEEFIFYDYNNPLDLPERIAAHSFDIVIADPPYLSEECLRKTSETVKYLTRGKILLCTGAIMEEQAAELLGVKMCTFVPRHTRNLANEFRCYVNYDSGLDCGI

SEQ ID NO: 852473 - protein, 105 aa, Homo sapiens
MYGEEFIFYDYNNPLDLPERIAAHSFDIVIADPPYLSEECLRKTSETVKYLTRGKILLCTGAIMEEQAAELLGVKMCTFVPRHTRNLANEFRCYVNYDSGLDCGI

SEQ ID NO: 852474 - protein, 214 aa, Homo sapiens; identical to SEQ ID NO: 852472

SEQ ID NO: 852475 - protein, 214 aa, Homo sapiens; identical to SEQ ID NO: 852472

SEQ ID NO: 852476 - protein, 302 aa, Homo sapiens
SHISATALRICEQPLTGCYFTTTDDMIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 852477 - protein, 251 aa, Homo sapiens
SHISATALRICEQPLTGCYFTTTDDMIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGKVLN

SEQ ID NO: 852478 - protein, 266 aa, Homo sapiens
SHISATALRICEQPLTGCYFTTTDDMIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGRKKHSCYSVMRDVGTQTIP

SEQ ID NO: 852479 - protein, 302 aa, Homo sapiens; identical to SEQ ID NO: 852476

SEQ ID NO: 852480 - protein, 305 aa, Homo sapiens
SHISATALRICEQPLTGCYFTTTDDMIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTDPHSRRVLPHTQKEGVLHREAKKNLDRQALLGLPTWSIAMRSHDLSNHISTWPSILHQT

SEQ ID NO: 852481 - protein, 221 aa, Homo sapiens
MSDGDYDYLIKFLALGDSGVGKTSVLYQYTDGKFNSKFITTVGIDFREKRVVYRASGPDGATGRGQRIHLQLWDTAGQERFRSLTTAFFRDAMGFLLLFDLTNEQSFLNVRNWISQLQMHAYCENPDIVLCGNKSDLEDQRVVKEEEAIALAEKYGIPYFETSAANGTNISQAIEMLLDLIMKRMERCVDKSWIPEGVVRSNGHASTDQLSEEKEKGACGC

SEQ ID NO: 852482 - protein, 85 aa, Homo sapiens
YDEGDKEQAGTGPEGIGGLCARGSENCWKAPGLWRGAGGSEFSDVEQAQNSRRYLSELLKTVTVIVDVSVGVNISDLKRFPGCGV

SEQ ID NO: 852483 - protein, 69 aa, Homo sapiens
SSHPTWWPPCGFLSPFPNRGIATRLWLGGLCARGSENCWKAPGLWRGAGGSEFSDVEQAQNSRRYLSGY

SEQ ID NO: 852484 - protein, 221 aa, Homo sapiens; identical to SEQ ID NO: 852481

SEQ ID NO: 852485 - protein, 221 aa, Homo sapiens; identical to SEQ ID NO: 852481

SEQ ID NO: 852486 - protein, 221 aa, Homo sapiens; identical to SEQ ID NO: 852481

SEQ ID NO: 852487 - protein, 213 aa, Homo sapiens
MSDGDYDYLIKFLALGDSGVGKTSVLYQYTDGKFNSKFITTVGIDFREKRVVYRASGPDGATGRGQRIHLQLWDTAGQERFRSLTTAFFRDAMGFLLLFDLTNEQSFLNVRNWISQLQMHAYCENPDIVLCGNKSDLEDQRVVKEEEAIPYFETSAANGTNISQAIEMLLDLIMKRMERCVDKSWIPEGVVRSNGHASTDQLSEEKEKGACGC

SEQ ID NO: 852488 - protein, 221 aa, Homo sapiens; identical to SEQ ID NO: 852481

SEQ ID NO: 852489 - protein, 73 aa, Homo sapiens
APTRRGGLLAVSFRRFRTEGLLLAFGLAVSVLGGPKTAGRPPVSGGEQAVASLVTWSRRRTVGDLKRFPGCGV

SEQ ID NO: 852490 - protein, 221 aa, Homo sapiens; identical to SEQ ID NO: 852481

SEQ ID NO: 852491 - protein, 221 aa, Homo sapiens; identical to SEQ ID NO: 852481

SEQ ID NO: 852492 - protein, 221 aa, Homo sapiens; identical to SEQ ID NO: 852481

SEQ ID NO: 852493 - protein, 221 aa, Homo sapiens; identical to SEQ ID NO: 852481

SEQ ID NO: 852494 - protein, 181 aa, Homo sapiens
MSDGDYDYLIKFLALGDSGVGKTSVLYQYTDGKFNSKFITTVGIDFREKRVVYRASGPDGATGRGQRIHLQLWDTAGQERFRSLTTAFFRDAMGFLLLFDLTNEQSFLNVRNWISQLQMHAYCENPDIVLCGNKSDLEDQRVVKEEEAIALAEKYGIPTLNDGAKGQRSNGSLARSMTGGT

SEQ ID NO: 852495 - protein, 69 aa, Homo sapiens; identical to SEQ ID NO: 852483

SEQ ID NO: 852496 - protein, 69 aa, Homo sapiens; identical to SEQ ID NO: 852483

SEQ ID NO: 852497 - protein, 846 aa, Homo sapiens
MEAPLRPAADILRRNPQQDYELVQRVGSGTYGDVYKARNVHTGELAAVKIIKLEPGDDFSLIQQEIFMVKECKHCNIVAYFGSYLSREKLWICMEYCGGGSLQDIYHVTGPLSELQIAYVCRETLQGLAYLHTKGKMHRDIKGANILLTDHGDVKLADFGVAAKITATIAKRKSFIGTPYWMAPEVAAVEKNGGYNQLCDIWAVGITAIELGELQPPMFDLHPMRALFLMSKSNFQPPKLKDKTKWSSTFHNFVKIALTKNPKKRPTAERLLTHTFVAQPGLSRALAVELLDKVNNPDNHAHYTEADDDDFEPHAIIRHTIRSTNRNARAERTASEINFDKLQFEPPLRKETEARDEMGLSSDPNFMLQWNPFVDGANTGKSTSKRAIPPPLPPKPRISSYPEDNFPDEEKASTIKHCPDSESRAPQILRRQSSPSCGPVAETSSIGNGDGISKLMSENTEGSAQAPQLPRKKDKRDFPKPAINGLPPTPKVLMGACFSKVFDGCPLKINCATSWIHPDTKDQYIIFGTEDGIYTLNLNELHEATMEQLFPRKCTWLYVINNTLMSLSEGKTFQLYSHNLIALFEHAKKPGLAAHIQTHRFPDRILPRKFALTTKIPDTKGCHKCCIVRNPYTGHKYLCGALQSGIVLLQWYEPMQKFMLIKHFDFPLPSPLNVFEMLVIPEQEYPMVCVAISKGTESNQVVQFETINLNSASSWFTEIGAGSQQLDSIHVTQLERDTVLVCLDKFVKIVNLQGKLKSSKKLASELSFDFRIESVVCLQDSVLAFWKHGMQGKSFKSDEVTQEISDETRVFRLLGSDRVVVLESRPTENPTAHSNLYILAGHENSY

SEQ ID NO: 852498 - protein, 846 aa, Homo sapiens; identical to SEQ ID NO: 852497

SEQ ID NO: 852499 - protein, 846 aa, Homo sapiens; identical to SEQ ID NO: 852497

SEQ ID NO: 852500 - protein, 779 aa, Homo sapiens
MVKECKHCNIVAYFGSYLSREKLWICMEYCGGGSLQDIYHVTGPLSELQIAYVCRETLQGLAYLHTKGKMHRDIKGANILLTDHGDVKLADFGVAAKITATIAKRKSFIGTPYWMAPEVAAVEKNGGYNQLCDIWAVGITAIELGELQPPMFDLHPMRALFLMSKSNFQPPKLKDKTKWSSTFHNFVKIALTKNPKKRPTAERLLTHTFVAQPGLSRALAVELLDKVNNPDNHAHYTEADDDDFEPHAIIRHTIRSTNRNARAERTASEINFDKLQFEPPLRKETEARDEMGLSSDPNFMLQWNPFVDGANTGKSTSKRAIPPPLPPKPRISSYPEDNFPDEEKASTIKHCPDSESRAPQILRRQSSPSCGPVAETSSIGNGDGISKLMSENTEGSAQAPQLPRKKDKRDFPKPAINGLPPTPKVLMGACFSKVFDGCPLKINCATSWIHPDTKDQYIIFGTEDGIYTLNLNELHEATMEQLFPRKCTWLYVINNTLMSLSEGKTFQLYSHNLIALFEHAKKPGLAAHIQTHRFPDRILPRKFALTTKIPDTKGCHKCCIVRNPYTGHKYLCGALQSGIVLLQWYEPMQKFMLIKHFDFPLPSPLNVFEMLVIPEQEYPMVCVAISKGTESNQVVQFETINLNSASSWFTEIGAGSQQLDSIHVTQLERDTVLVCLDKFVKIVNLQGKLKSSKKLASELSFDFRIESVVCLQDSVLAFWKHGMQGKSFKSDEVTQEISDETRVFRLLGSDRVVVLESRPTENPTAHSNLYILAGHENSY

SEQ ID NO: 852501 - protein, 726 aa, Homo sapiens
MDLYGILWWRITSRYLPCYWTIIRIANSLCMQRNLTADFGVAAKITATIAKRKSFIGTPYWMAPEVAAVEKNGGYNQLCDIWAVGITAIELGELQPPMFDLHPMRALFLMSKSNFQPPKLKDKTKWSSTFHNFVKIALTKNPKKRPTAERLLTHTFVAQPGLSRALAVELLDKVNNPDNHAHYTEADDDDFEPHAIIRHTIRSTNRNARAERTASEINFDKLQFEPPLRKETEARDEMGLSSDPNFMLQWNPFVDGANTGKSTSKRAIPPPLPPKPRISSYPEDNFPDEEKASTIKHCPDSESRAPQILRRQSSPSCGPVAETSSIGNGDGISKLMSENTEGSAQAPQLPRKKDKRDFPKPAINGLPPTPKVLMGACFSKVFDGCPLKINCATSWIHPDTKDQYIIFGTEDGIYTLNLNELHEATMEQLFPRKCTWLYVINNTLMSLSEGKTFQLYSHNLIALFEHAKKPGLAAHIQTHRFPDRILPRKFALTTKIPDTKGCHKCCIVRNPYTGHKYLCGALQSGIVLLQWYEPMQKFMLIKHFDFPLPSPLNVFEMLVIPEQEYPMVCVAISKGTESNQVVQFETINLNSASSWFTEIGAGSQQLDSIHVTQLERDTVLVCLDKFVKIVNLQGKLKSSKKLASELSFDFRIESVVCLQDSVLAFWKHGMQGKSFKSDEVTQEISDETRVFRLLGSDRVVVLESRPTENPTAHSNLYILAGHENSY

SEQ ID NO: 852502 - protein, 610 aa, Homo sapiens
ILYSTNIQDTQHYPLNHQWKMYTYNSEKRPTAERLLTHTFVAQPGLSRALAVELLDKVNNPDNHAHYTEADDDDFEPHAIIRHTIRSTNRNARAERTASEINFDKLQFEPPLRKETEARDEMGLSSDPNFMLQWNPFVDGANTGKSTSKRAIPPPLPPKPRISSYPEDNFPDEEKASTIKHCPDSESRAPQILRRQSSPSCGPVAETSSIGNGDGISKLMSENTEGSAQAPQLPRKKDKRDFPKPAINGLPPTPKVLMGACFSKVFDGCPLKINCATSWIHPDTKDQYIIFGTEDGIYTLNLNELHEATMEQLFPRKCTWLYVINNTLMSLSEGKTFQLYSHNLIALFEHAKKPGLAAHIQTHRFPDRILPRKFALTTKIPDTKGCHKCCIVRNPYTGHKYLCGALQSGIVLLQWYEPMQKFMLIKHFDFPLPSPLNVFEMLVIPEQEYPMVCVAISKGTESNQVVQFETINLNSASSWFTEIGAGSQQLDSIHVTQLERDTVLVCLDKFVKIVNLQGKLKSSKKLASELSFDFRIESVVCLQDSVLAFWKHGMQGKSFKSDEVTQEISDETRVFRLLGSDRVVVLESRPTENPTAHSNLYILAGHENSY

SEQ ID NO: 852503 - protein, 846 aa, Homo sapiens; identical to SEQ ID NO: 852497

SEQ ID NO: 852504 - protein, 805 aa, Homo sapiens
MEAPLRPAADILRRNPQQDYELVQRVGSGTYGDVYKARNVHTGELAAVKIIKLEPGDDFSLIQQEIFMVKECKHCNIVAYFGSYLSREKLWICMEYCGGGSLQDIYHVTGPLSELQIAYVCRETLQGLAYLHTKGKMHRDIKGANILLTDHGDVKLADFGVAAKITATIAKRKSFIGTPYWMAPEVAAVEKNGGYNQLCDIWAVGITAIELGELQPPMFDLHPMRALFLMSKSNFQPPKLKDKTKWSSTFHNFVKIALTKNPKKRPTAERLLTHTFVAQPGLSRALAVELLDKVNNPDNHAHYTEADDDDFEPHAIIRHTIRSTNRNARAERTASEINFDKLQFEPPLRKETEARDEMGLSSDPNFMLQWNPFVDGANTGKSTSKRAIPPPLPPKPRISSYPEDNFPDEEKASTIKHCPDSESRAPQILRRQSSPSCGPVAETSSIGNGDGISKLMSENTEGSAQAPQLPRKKDKRDFPKPAINGLPPTPKVLMGACFSKVFDGCPLKINCATSWIHPDTKDQYIIFGTEDGIYTLNLNELHEATMEQLFPRKCTWLYVINNTLMSLSEGKTFQLYSHNLIALFEHAKKPGLAAHIQTHRFPDRILPRKFALTTKIPDTKGCHKCCIVRNPYTGHKYLCGALQSGIVLLQWYEPMQKFMLIKHFDFPLPSPLNVFEMLVIPEQEYPMVCVAISKGTESNQVVQFETINLNSASSWFTEIGAGSQQLDSIHVTQLERDTVLVCLDKFVKIVNLQGKLKSSKKLASELSFDFRIESVVCLQDSVLAFWKHGMQGKSFKSDEGCRFGK

SEQ ID NO: 852505 - protein, 761 aa, Homo sapiens
MEAPLRPAADILRRNPQQDYELVQRVGSGTYGDVYKARNVHTGELAAVKIIKLEPGDDFSLIQQEIFMVKECKHCNIVAYFGSYLSREKLWICMEYCGGGSLQDIYHVTGPLSELQIAYVCRETLQGLAYLHTKGKMHRDIKGANILLTDHGDVKLADFGVAAKITATIAKRKSFIGTPYWMAPEVAAVEKNGGYNQLCDIWAVGITAIELGELQPPMFDLHPMRALFLMSKSNFQPPKLKDKTKWSSTFHNFVKIALTKNPKKRPTAERLLTHTFVAQPGLSRALAVELLDKVNNPDNHAHYTEADDDDFEPHAIIRHTIRSTNRNARAERTASEINFDKLQFEPPLRKETEARDEMGLSSDPNFMLQWNPFVDGANTGKSTSKRAIPPPLPPKPRISSYPEDNFPDEEKASTIKHCPDSESRAPQILRRQSSPSCGPVAETSSIGNGDGISKLMSENTEGSAQAPQLPRKKDKRDFPKPAINGLPPTPKVLMGACFSKVFDGCPLKINCATSWIHPDTKDQYIIFGTEDGIYTLNLNELHEATMEQLFPRKCTWLYVINNTLMSLSEGKTFQLYSHNLIALFEHAKKPGLAAHIQTHRFPDRILPRKFALTTKIPDTKGCHKCCIVRNPYTGHKYLCGALQSGIVLLQWYEPMQKFMLIKHFDFPLPSPLNVFEMLVIPEQEYPMVCVAISKGTESNQVVQFETINLNSASSWFTEIGAGSQQLDSIHVTQLERDTVLVCLDNCDLSSTRTFNQLATGL

SEQ ID NO: 852506 - protein, 578 aa, Homo sapiens
MEAPLRPAADILRRNPQQDYELVQRVGSGTYGDVYKARNVHTGELAAVKIIKLEPGDDFSLIQQEIFMVKECKHCNIVAYFGSYLSREKLWICMEYCGGGSLQDIYHVTGPLSELQIAYVCRETLQGLAYLHTKGKMHRDIKGANILLTDHGDVKLADFGVAAKITATIAKRKSFIGTPYWMAPEVAAVEKNGGYNQLCDIWAVGITAIELGELQPPMFDLHPMRALFLMSKSNFQPPKLKDKTKWSSTFHNFVKIALTKNPKKRPTAERLLTHTFVAQPGLSRALAVELLDKVNNPDNHAHYTEADDDDFEPHAIIRHTIRSTNRNARAERTASEINFDKLQFEPPLRKETEARDEMGLSSDPNFMLQWNPFVDGANTGKSTSKRAIPPPLPPKPRISSYPEDNFPDEEKASTIKHCPDSESRAPQILRRQSSPSCGPVAETSSIGNGDGISKLMSENTEGSAQAPQLPRKKDKRDFPKPAINGLPPTPKVLMGACFSKVFDGCPLKINCATSWIHPDTKDQYIIFGTEDGIYTLNLNELHEATMEQLFPRKCTWLYVINNTLMSLSGMYVMMKNKP

SEQ ID NO: 852507 - protein, 465 aa, Homo sapiens
MLPLWTLSLLLGAVAGKEVCYERLGCFSDDSPWSGITERPLHILPWSPKDVNTRFLLYTNENPNNFQEVAADSSSISGSNFKTNRKTRFIIHGFIDKGEENWLANVCKNLFKVESVNCICVDWKGGSRTGYTQASQNIRIVGAEVAYFVEFLQSAFGYSPSNVHVIGHSLGAHAAGEAGRRTNGTIGRITGLDPAEPCFQGTPELVRLDPSDAKFVDVIHTDGAPIVPNLGFGMSQVVGHLDFFPNGGVEMPGCKKNILSQIVDIDGIWEGTRDFAACNHLRSYKYYTDSIVNPDGFAGFPCASYNVFTANKCFPCPSGGCPQMGHYADRYPGKTNDVGQKFYLDTGDASNFARWRYKVSVTLSGKKVTGHILVSLFGNKGNSKQYEIFKGTLKPDSTHSNEFDSDVDVGDLQMVKFIWYNNVINPTLPRVGASKIIVETNVGKQFNFCSPETVREEVLLTLTPC

SEQ ID NO: 852508 - protein, 465 aa, Homo sapiens; identical to SEQ ID NO: 852507

SEQ ID NO: 852509 - protein, 465 aa, Homo sapiens; identical to SEQ ID NO: 852507

SEQ ID NO: 852510 - protein, 465 aa, Homo sapiens; identical to SEQ ID NO: 852507

SEQ ID NO: 852511 - protein, 418 aa, Homo sapiens
SFWGIAGKEVCYERLGCFSDDSPWSGITERPSNFKTNRKTRFIIHGFIDKGEENWLANVCKNLFKVESVNCICVDWKGGSRTGYTQASQNIRIVGAEVAYFVEFLQSAFGYSPSNVHVIGHSLGAHAAGEAGRRTNGTIGRITGLDPAEPCFQGTPELVRLDPSDAKFVDVIHTDGAPIVPNLGFGMSQVVGHLDFFPNGGVEMPGCKKNILSQIVDIDGIWEGTRDFAACNHLRSYKYYTDSIVNPDGFAGFPCASYNVFTANKCFPCPSGGCPQMGHYADRYPGKTNDVGQKFYLDTGDASNFARWRYKVSVTLSGKKVTGHILVSLFGNKGNSKQYEIFKGTLKPDSTHSNEFDSDVDVGDLQMVKFIWYNNVINPTLPRVGASKIIVETNVGKQFNFCSPETVREEVLLTLTPC

SEQ ID NO: 852512 - protein, 135 aa, Homo sapiens
MTPHGQELRKDPSIYCLGLQKMSTPASSYILMRTQTTFKKLPQIHQASVAPISKQIEKLAGTLKPDSTHSNEFDSDVDVGDLQMVKFIWYNNVINPTLPRVGASKIIVETNVGKQFNFCSPETVREEVLLTLTPC

SEQ ID NO: 852513 - protein, 160 aa, Homo sapiens
MLPLWTLSLLLGAVAGKEVCYERLGCFSDDSPWSGITERPLHILPWSPKDVNTRFLLYTNENPNNFQEVAADSSSISGSNFKTNRKTRFIIHGFIDKGEENWLANVCKNLFKVESVNCICVDWKGGSRTGYTQASQNIRIVGAEVAYFVEFLQGNYSRIA

SEQ ID NO: 852514 - protein, 140 aa, Homo sapiens
MLPLWTLSLLLGAVAGKEVCYERLGCFSDDSPWSGITERPLHILPWSPKDVNTRFLLYTNENPNNFQEVAADSSSISGSNFKTNRKTRFIIHGFIDKGEENWLANVCKNLFKVESVNCICVDWKGGSRNQDRGSRSGIFC

SEQ ID NO: 852515 - protein, 322 aa, Homo sapiens
RSNRLYHTAQSAFGYSPSNVHVIGHSLGAHAAGEAGRRTNGTIGRITGLDPAEPCFQGTPELVRLDPSDAKFVDVIHTDGAPIVPNLGFGMSQVVGHLDFFPNGGVEMPGCKKNILSQIVDIDGIWEGTRDFAACNHLRSYKYYTDSIVNPDGFAGFPCASYNVFTANKCFPCPSGGCPQMGHYADRYPGKTNDVGQKFYLDTGDASNFARWRYKVSVTLSGKKVTGHILVSLFGNKGNSKQYEIFKGTLKPDSTHSNEFDSDVDVGDLQMVKFIWYNNVINPTLPRVGASKIIVETNVGKQFNFCSPETVREEVLLTLTPC

SEQ ID NO: 852516 - protein, 153 aa, Homo sapiens
MLPLWTLSLLLGAVAGKEVCYERLGCFSDDSPWSGITERPLHILPWSPKDVNTRFLLYTNENPNNFQEVAADSSSISGSNFKTNRKTRFIIHGFIDKGEENWLANVCKNLFKVESVNCICVDWKGGSRTGYTQASQNIRIVGAEVAYFVEFLQ

SEQ ID NO: 852517 - protein, 189 aa, Homo sapiens
MLPLWTLSLLLGAVAGKEVCYERLGCFSDDSPWSGITERPLHILPWSPKDVNTRFLLYTNENPNNFQEVAADSSSISGSNFKTNRKTRKKKKFGGGGAEEGLPKNPIWVVGGAGRHDGYGRPRAPTARVPKEKPGRHRTAAAVVFPKKKTRRGGHRAGSSDNPRRGVQRGTTGAHSREALGRQINCPPR

SEQ ID NO: 852518 - protein, 963 aa, Homo sapiens
MLHFHLLKFKTRVIFSAVIIMVTGLCLFLLSLPHLHGVFEQVPAPWWTSLCPWPIMEAAAFQSGSLYPVASFLAAPMSELVPDLSFQVDLHTGLSEFSVTQRRLAHGWNEFVADNSEPVWKKYLDQFKNPLILLLLGSALVSVLTKEYEDAVSIATAVLVVVTVAFIQEYRSEKSLEELTKLVPPECNCLREGKLQHLLARELVPGDVVSLSIGDRIPADIRLTEVTDLLVDESSFTGEAEPCSKTDSPLTGGGDLTTLSNIVFMGTLVQYGRGQGVVIGTGESSQFGEVFKMMQAEETPKTPLQKSMDRLGKQLTLFSFGIIGLIMLIGWSQGKQLLSMFTIGVSLAVAAIPEGLPIVVMVTLVLGVLRMAKKRVIVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALAMKMDLSDIKNSYIRKKEIPFSSEQKWMAVKCSLKTEDQEDIYFMKGALEEVIRYCTMYNNGGIPLPLTPQQRSFCLQEEKRMGSLGLRVLALASGPELGRLTFLGLVGIIDPPRVGVKEAVQVLSESGVSVKMITGDALETALAIGRNIGLCNGKLQAMSGEEVDSVEKGELADRVGKVSVFFRTSPKHKLKIIKALQESGAIVAMTGDGVNDAVALKSADIGIAMGQTGTDVSKEAANMILVDDDFSAIMNAVEEGKGIFYNIKNFVRFQLSTSISALSLITLSTVFNLPSPLNAMQILWINIIMDGPPAQSLGVEPVDKDAFRQPPRSVRDTILSRALILKILMSAAIIFSGTLFIFWKEMPEDRASTPRTTTMTFTCFVFFDLFNALTCRSQTKLIFEIGFLRNHMFLYSVLGSILGQLAVIYIPPLQRVFQTENLGALDLLFLTGLASSVFILSELLKLCEKYCCSPKRVQMHPEDV

SEQ ID NO: 852519 - protein, 1023 aa, Homo sapiens
MLHFHLLKFKTRVIFSAVIIMVTGLCLFLLSLPHLHGVFEQVPAPWWTSLCPWPIMEAAAFQSGSLYPVASFLAAPMSELVPDLSFQVDLHTGLSEFSVTQRRLAHGWNEFVADNSEPVWKKYLDQFKNPLILLLLGSALVSVLTKEYEDAVSIATAVLVVVTVAFIQVSISEVPVRVSWAGQELHGVPTFKQHICCASCQEYRSEKSLEELTKLVPPECNCLREGKLQHLLARELVPGDVVSLSIGDRIPADIRLTEVTDLLVDESSFTGEAEPCSKTDSPLTGGGDLTTLSNIVFMGTLVQYGRGQGVVIGTGESSQFGEVFKMMQAEETPKTPLQKSMDRLGKQLTLFSFGIIGLIMLIGWSQGKQLLSMFTIGVSLAVAAIPEGLPIVVMVTLVLGVLRMAKKRVIVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALAMKMDLSDIKNSYIRKKEIPFSSEQKWMAVKCSLKTEDQEDIYFMKGALEEVIRYCTMYNNGGIPLPLTPQQRSFCLQEEKRMGSLGLRVLALASGPELGRLTFLGLVGIIDPPRVGVKEAVQVLSESGVSVKMITGDALETALAIGRNIGLCNGKLQAMSGEEVDSVEKGELADRVGKVSVFFRTSPKHKLKIIKALQESGAIVAMTGDGVNDAVALKSADIGIAMGQTGTDVSKEAANMILVDDDFSAIMNAVEEGKGIFYNIKNFVRFQLSTEVEASIPSVIKHHAWRAAADWLRVPRRSISALSLITLSTVFNLPSPLNAMQILWINIIMDGPPAQSLGVEPVDKDAFRQPPRSVRDTILSRALILKILMSAAIIFSGTLFIFWKEMPEDRASTPRTTTMTFTCFVFFDLFNALTCRSQTKLIFEIGFLRNHMFLYSVLGSILGQLAVIYIPPLQRVFQTENLGALDLLFLTGLASSVFILSELLKLCEKYCCSPKRVQMHPEDV

SEQ ID NO: 852520 - protein, 635 aa, Homo sapiens
IGRNIGLCNGKLQAMSGEEVDSVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALAMKMDLSDIKNSYIRKKEIPFSSEQKWMAVKCSLKTEDQEDIYFMKGALEEVIRYCTMYNNGGIPLPLTPQQRSFCLQEEKRMGSLGLRVLALASGPELGRLTFLGLVGIIDPPRVGVKEAVQVLSESGVSVKMITGDALETALAIGRNIGLCNGKLQAMSGEEVDSVEKGELADRVGKVSVFFRTSPKHKLKIIKALQESGAIVAMTGDGVNDAVALKSADIGIAMGQTGTDVSKEAANMILVDDDFSAIMNAVEEGKGIFYNIKNFVRFQLSTEVEASIPSVIKHHAWRAAADWLRVPRRSISALSLITLSTVFNLPSPLNAMQILWINIIMDGPPAQSLGVEPVDKDAFRQPPRSVRDTILSRALILKILMSAAIIFSGTLFIFWKEMPEDRASTPRTTTMTFTCFVFFDLFNALTCRSQTKLIFEIGFLRNHMFLYSVLGSILGQLAVIYIPPLQRVFQTENLGALDLLFLTGLASSVFILSELLKLCEKYCCSPKRVQMHPEDV

SEQ ID NO: 852521 - protein, 369 aa, Homo sapiens
MHGALRESGQGWGPPGLGRRVIHGLIGGIRCTLGTEGRTWLKDQFPVGRGAPVRTPPSPTNVSPRMPARGTSRGPSITSIWASHHCPLQQPMHWSSPHAGPLREEMALFSCRNAVEEGKGIFYNIKNFVRFQLSTEVEASIPSVIKHHAWRAAADWLRVPRRSISALSLITLSTVFNLPSPLNAMQILWINIIMDGPPAQSLGVEPVDKDAFRQPPRSVRDTILSRALILKILMSAAIIFSGTLFIFWKEMPEDRASTPRTTTMTFTCFVFFDLFNALTCRSQTKLIFEIGFLRNHMFLYSVLGSILGQLAVIYIPPLQRVFQTENLGALDLLFLTGLASSVFILSELLKLCEKYCCSPKRVQMHPEDV

SEQ ID NO: 852522 - protein, 934 aa, Homo sapiens
MLHFHLLKFKTRVIFSAVIIMVTGLCLFLLSLPHLHGVFEQVPAPWWTSLCPWPIMEAAAFQSGSLYPVASFLAAPMSELVPDLSFQVDLHTGLSEFSVTQRRLAHGWNEFVADNSEPVWKKYLDQFKNPLILLLLGSALVSVLTKEYEDAVSIATAVLVVVTVAFIQVSISEVPVRVSWAGQELHGVPTFKQHICCASCQEYRSEKSLEELTKLVPPECNCLREGKLQHLLARELVPGDVVSLSIGDRIPADIRLTEVTDLLVDESSFTGEAEPCSKTDSPLTGGGDLTTLSNIVFMGTLVQYGRGQGVVIGTGESSQFGEVFKMMQAEETPKTPLQKSMDRLGKQLTLFSFGIIGLIMLIGWSQGKQLLSMFTIGVSLAVAAIPEGLPIVVMVTLVLGVLRMAKKRVIVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALAMKMDLSDIKNSYIRKKEIPFSSEQKWMAVKCSLKTEDQEDIYFMKGALEEVIRYCTMYNNGGIPLPLTPQQRSFCLQEEKRMGSLGLRVLALASGPELGRLTFLGLVGIIDPPRVGVKEAVQVLSESGVSVKMITGDALETALAIGRNIGLCNGKLQAMSGEEVDSVEKGELADRVGKVSVFFRTSPKHKLKIIKALQESGAIVAMTGDGVNDAVALKSADIGIAMGQTGTDVSKEAANMILVDDDFSAIMNAVEEGKGIFYNIKNFVRFQLSTEVEASIPSVIKHHAWRAAADWLRVPRRSISALSLITLSTVFNLPSPLNAMQILWINIIMDGPPAQSLGVEPVDKDAFRQPPRSVRDTILSRALILKILMSAAIIFSGTLFIFWKEEMTFTLGLTGVASPPRETVTSWRKWCFLHP

SEQ ID NO: 852523 - protein, 909 aa, Homo sapiens
MLHFHLLKFKTRVIFSAVIIMVTGLCLFLLSLPHLHGVFEQVPAPWWTSLCPWPIMEAAAFQSGSLYPVASFLAAPMSELVPDLSFQVDLHTGLSEFSVTQRRLAHGWNEFVADNSEPVWKKYLDQFKNPLILLLLGSALVSVLTKEYEDAVSIATAVLVVVTVAFIQVSISEVPVRVSWAGQELHGVPTFKQHICCASCQEYRSEKSLEELTKLVPPECNCLREGKLQHLLARELVPGDVVSLSIGDRIPADIRLTEVTDLLVDESSFTGEAEPCSKTDSPLTGGGDLTTLSNIVFMGTLVQYGRGQGVVIGTGESSQFGEVFKMMQAEETPKTPLQKSMDRLGKQLTLFSFGIIGLIMLIGWSQGKQLLSMFTIGVSLAVAAIPEGLPIVVMVTLVLGVLRMAKKRVIVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALAMKMDLSDIKNSYIRKKEIPFSSEQKWMAVKCSLKTEDQEDIYFMKGALEEVIRYCTMYNNGGIPLPLTPQQRSFCLQEEKRMGSLGLRVLALASGPELGRLTFLGLVGIIDPPRVGVKEAVQVLSESGVSVKMITGDALETALAIGRNIGLCNGKLQAMSGEEVDSVEKGELADRVGKVSVFFRTSPKHKLKIIKALQESGAIVAMTGDGVNDAVALKSADIGIAMGQTGTDVSKEAANMILVDDDFSAIMNAVEEGKGIFYNIKNFVRFQLSTEVEASIPSVIKHHAWRAAADWLRVPRRSISALSLITLSTVFNLPSPLNAMQILWINIIMDGPPAQSLGVEPVDKDAFRQPPRSVRDTILSRALILKILMSAAIIFSGTLFIFWKELSLYY

SEQ ID NO: 852524 - protein, 855 aa, Homo sapiens
MLHFHLLKFKTRVIFSAVIIMVTGLCLFLLSLPHLHGVFEQVPAPWWTSLCPWPIMEAAAFQSGSLYPVASFLAAPMSELVPDLSFQVDLHTGLSEFSVTQRRLAHGWNEFVADNSEPVWKKYLDQFKNPLILLLLGSALVSVLTKEYEDAVSIATAVLVVVTVAFIQVSISEVPVRVSWAGQELHGVPTFKQHICCASCQEYRSEKSLEELTKLVPPECNCLREGKLQHLLARELVPGDVVSLSIGDRIPADIRLTEVTDLLVDESSFTGEAEPCSKTDSPLTGGGDLTTLSNIVFMGTLVQYGRGQGVVIGTGESSQFGEVFKMMQAEETPKTPLQKSMDRLGKQLTLFSFGIIGLIMLIGWSQGKQLLSMFTIGVSLAVAAIPEGLPIVVMVTLVLGVLRMAKKRVIVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALAMKMDLSDIKNSYIRKKEIPFSSEQKWMAVKCSLKTEDQEDIYFMKGALEEVIRYCTMYNNGGIPLPLTPQQRSFCLQEEKRMGSLGLRVLALASGPELGRLTFLGLVGIIDPPRVGVKEAVQVLSESGVSVKMITGDALETALAIGRNIGLCNGKLQAMSGEEVDSVEKGELADRVGKVSVFFRTSPKHKLKIIKALQESGAIVAMTGDGVNDAVALKSADIGIAMGQTGTDVSKEAANMILVDDDFSAIMNAVEEGKGIFYNIKNFVRFQLSTEVEASIPSVIKHHAWRAAADWLRVPRRSISALSLITLSTVFNLPSPLNAMQILWINIIMDGPPAQR

SEQ ID NO: 852525 - protein, 172 aa, Homo sapiens
MLHFHLLKFKTRVIFSAVIIMVTGLCLFLLSLPHLHGVFEQVPAPWWTSLCPWPIMEAAAFQSGSLYPVASFLAAPMSELVPDLSFQVDLHTGLSEFSVTQRRLAHGWNEFVADNSEPVWKKYLDQFKNPLILLLLGSALVSVLTKEYEDAVSIATAVLVVVTVAFIQVSIS

SEQ ID NO: 852526 - protein, 112 aa, Homo sapiens
LPFVFSKDQEDIYFMKGALEEVIRYCTMYNNGGIPLPLTPQQRSFCLQEEKRMGSLGLRGQCLWSRPRALSLHVTLTFKCIQAGSLVKEVTRPKESGSMLTAIMCAWNLMVT

SEQ ID NO: 852527 - protein, 963 aa, Homo sapiens; identical to SEQ ID NO: 852518

SEQ ID NO: 852528 - protein, 381 aa, Homo sapiens
DLKNTKQVNVIVVVRGVLALSSGISFQKIKRVPRTGDALETALAIGRNIGLCNGKLQAMSGEEVDSVEKGELADRVGKVSVFFRTSPKHKLKIIKALQESGAIVAMTGDGVNDAVALKSADIGIAMGQTGTDVSKEAANMILVDDDFSAIMNAVEEGKGIFYNIKNFVRFQLSTSISALSLITLSTVFNLPSPLNAMQILWINIIMDGPPAQSLGVEPVDKDAFRQPPRSVRDTILSRALILKILMSAAIIFSGTLFIFWKEMPEDRASTPRTTTMTFTCFVFFDLFNALTCRSQTKLIFEIGFLRNHMFLYSVLGSILGQLAVIYIPPLQRVFQTENLGALDLLFLTGLASSVFILSELLKLCEKYCCSPKRVQMHPEDV

SEQ ID NO: 852529 - protein, 909 aa, Homo sapiens; identical to SEQ ID NO: 852523

SEQ ID NO: 852530 - protein, 924 aa, Homo sapiens
MLHFHLLKFKTRVIFSAVIIMVTGLCLFLLSLPHLHGVFEQVPAPWWTSLCPWPIMEAAAFQSGSLYPVASFLAAPMSELVPDLSFQVDLHTGLSEFSVTQRRLAHGWNEFVADNSEPVWKKYLDQFKNPLILLLLGSALVSVLTKEYEDAVSIATAVLVVVTVAFIQVSISEVPVRVSWAGQELHGVPTFKQHICCASCQEYRSEKSLEELTKLVPPECNCLREGKLQHLLARELVPGDVVSLSIGDRIPADIRLTEVTDLLVDESSFTGEAEPCSKTDSPLTGGGDLTTLSNIVFMGTLVQYGRGQGVVIGTGESSQFGEVFKMMQAEETPKTPLQKSMDRLGKQLTLFSFGIIGLIMLIGWSQGKQLLSMFTIGVSLAVAAIPEGLPIVVMVTLVLGVLRMAKKRVIVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALAMKMDLSDIKNSYIRKKEIPFSSEQKWMAVKCSLKTEDQEDIYFMKGALEEVIRYCTMYNNGGIPLPLTPQQRSFCLQEEKRMGSLGLRVLALASGPELGRLTFLGLVGIIDPPRVGVKEAVQVLSESGVSVKMITGDALETALAIGRNIGLCNGKLQAMSGEEVDSVEKGELADRVGKVSVFFRTSPKHKLKIIKALQESGAIVAMTGDGVNDAVALKSADIGIAMGQTGTDVSKEAANMILVDDDFSAIMNAVEEGKGIFYNIKNFVRFQLSTEVEASIPSVIKHHAWRAAADWLRVPRRSISALSLITLSTVFNLPSPLNAMQILWINIIMDGPPAQSLGVEPVDKDAFRQPPRSVRDTILSRALILKILMSAAIIFSGTLFIFWKEVPCPHPHGGSKSACAGETLG

SEQ ID NO: 852531 - protein, 666 aa, Homo sapiens
MLHFHLLKFKTRVIFSAVIIMVTGLCLFLLSLPHLHGVFEQVPAPWWTSLCPWPIMEAAAFQSGSLYPVASFLAAPMSELVPDLSFQVDLHTGLSEFSVTQRRLAHGWNEFVADNSEPVWKKYLDQFKNPLILLLLGSALVSVLTKEYEDAVSIATAVLVVVTVAFIQVSISEVPVRVSWAGQELHGVPTFKQHICCASCQEYRSEKSLEELTKLVPPECNCLREGKLQHLLARELVPGDVVSLSIGDRIPADIRLTEVTDLLVDESSFTGEAEPCSKTDSPLTGGGDLTTLSNIVFMGTLVQYGRGQGVVIGTGESSQFGEVFKMMQAEETPKTPLQKSMDRLGKQLTLFSFGIIGLIMLIGWSQGKQLLSMFTIGVSLAVAAIPEGLPIVVMVTLVLGVLRMAKKRVIVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALAMKMDLSDIKNSYIRKKEIPFSSEQKWMAVKCSLKTEDQEDIYFMKGALEEVIRYCTMYNNGGIPLPLTPQQRSFCLQEEKRMGSLGLRVLALASGPELGRLTFLGLVGIIDPPRVGVKEAVQVLSESGVSVKMIETGSERGKLALSGRNWL

SEQ ID NO: 852532 - protein, 172 aa, Homo sapiens; identical to SEQ ID NO: 852525

SEQ ID NO: 852533 - protein, 135 aa, Homo sapiens
MFHVVYDIGVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAWCSVVRPVPLNFCPIC

SEQ ID NO: 852534 - protein, 186 aa, Homo sapiens
SSSVSRVGPCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKNVTAHYNLAECILILSVQHLALS

SEQ ID NO: 852535 - protein, 2364 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRLNDGNEYLFQAKDDEEMNTWIQAISSAISSDKHEVSASTQSTPASSRAQTLPTSVVTITSESSPGKREKDKEKDKEKRFSLFGKKK

SEQ ID NO: 852536 - protein, 2364 aa, Homo sapiens; identical to SEQ ID NO: 852535

SEQ ID NO: 852537 - protein, 2364 aa, Homo sapiens; identical to SEQ ID NO: 852535

SEQ ID NO: 852538 - protein, 2364 aa, Homo sapiens; identical to SEQ ID NO: 852535

SEQ ID NO: 852539 - protein, 2364 aa, Homo sapiens; identical to SEQ ID NO: 852535

SEQ ID NO: 852540 - protein, 2364 aa, Homo sapiens; identical to SEQ ID NO: 852535

SEQ ID NO: 852541 - protein, 2364 aa, Homo sapiens; identical to SEQ ID NO: 852535

SEQ ID NO: 852542 - protein, 2335 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEVLEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRLNDGNEYLFQAKDDEEMNTWIQAISSAISSDKHEVSASTQSTPASSRAQTLPTSVVTITSESSPGKREKDKEKDKEKRFSLFGKKK

SEQ ID NO: 852543 - protein, 2168 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRVSYRSQTYQNYKNFNSRRTASDQPWSGL

SEQ ID NO: 852544 - protein, 2279 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRD

SEQ ID NO: 852545 - protein, 2303 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRLNDGNEYLFQAKDKEKRFSLFGKKK

SEQ ID NO: 852546 - protein, 2200 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPTSVVTITSESSPGKREKDKEKDKEKRFSLFGKKK

SEQ ID NO: 852547 - protein, 1759 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRLNDGNEYLFQAKDDEEMNTWIQAISSAISSDKHEVSASTQSTPASSRAQTLPTSVVTITSESSPGKREKDKEKDKEKRFSLFGKKK

SEQ ID NO: 852548 - protein, 2364 aa, Homo sapiens; identical to SEQ ID NO: 852535

SEQ ID NO: 852549 - protein, 2364 aa, Homo sapiens; identical to SEQ ID NO: 852535

SEQ ID NO: 852550 - protein, 2364 aa, Homo sapiens; identical to SEQ ID NO: 852535

SEQ ID NO: 852551 - protein, 438 aa, Homo sapiens
RSPRGSQIEVRVEPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRLNDGNEYLFQAKDDEEMNTWIQAISSAISSDKHEVSASTQSTPASSRAQTLPTSVVTITSESSPGKREKDKEKDKEKRFSLFGKKK

SEQ ID NO: 852552 - protein, 2338 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRLNDGNEYLFQAKDDEEMNTWIQAISSAISSDKHEVSASTQSTPASSRAQTLPNSVVTMMQ

SEQ ID NO: 852553 - protein, 2279 aa, Homo sapiens; identical to SEQ ID NO: 852544

SEQ ID NO: 852554 - protein, 2267 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALD

SEQ ID NO: 852555 - protein, 2309 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYFSTSSTLWHISRVDRYGSCPSSQASATLASLEKLMDLQNQS

SEQ ID NO: 852556 - protein, 2168 aa, Homo sapiens; identical to SEQ ID NO: 852543

SEQ ID NO: 852557 - protein, 2000 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDIDRNELQRLGLNREVVAQAWCSVVRPVPLNFCPIC

SEQ ID NO: 852558 - protein, 1738 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTVKLF

SEQ ID NO: 852559 - protein, 1545 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQEPMMSRNPPDPNDG

SEQ ID NO: 852560 - protein, 1591 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEIVSRPLLHMVFPRAPLPVLKPTFSLLSHPHLGPRWQAELPKSRRLWKFFWEMAEEEGWIREKEKILSSDDYGKDLTSVMRLLSKHRAFEDEMSG

SEQ ID NO: 852561 - protein, 1199 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQVRFVPAFASFR

SEQ ID NO: 852562 - protein, 1032 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQA

SEQ ID NO: 852563 - protein, 575 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHQHEFP

SEQ ID NO: 852564 - protein, 174 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVESARDPLEQL

SEQ ID NO: 852565 - protein, 51 aa, Homo sapiens
MEFCYQELCQLAAERRARLEESRRLWKFFWEMAEEEGWIREKEKILSSDDY

SEQ ID NO: 852566 - protein, 215 aa, Homo sapiens
MVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRLNDGNEYLFQAKDDEEMNTWIQAISSAISSDKHEVSASTQSTPASSRAQTLPTSVVTITSESSPGKREKDKEKDKEKRFSLFGKKK

SEQ ID NO: 852567 - protein, 93 aa, Homo sapiens
SSPVPSHLPYRLISLTVLISLTVLISLTIAEWKDGLNEAWADLLELIDTRTQILAASYELHKFYHDAKEIFDGKGDEDGKGDETVREMRREGD

SEQ ID NO: 852568 - protein, 2364 aa, Homo sapiens; identical to SEQ ID NO: 852535

SEQ ID NO: 852569 - protein, 2364 aa, Homo sapiens; identical to SEQ ID NO: 852535

SEQ ID NO: 852570 - protein, 2364 aa, Homo sapiens; identical to SEQ ID NO: 852535

SEQ ID NO: 852571 - protein, 2364 aa, Homo sapiens; identical to SEQ ID NO: 852535

SEQ ID NO: 852572 - protein, 2364 aa, Homo sapiens; identical to SEQ ID NO: 852535

SEQ ID NO: 852573 - protein, 2364 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIQGKYTWVTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRLNDGNEYLFQAKDDEEMNTWIQAISSAISSDKHEVSASTQSTPASSRAQTLPTSVVTITSESSPGKREKDKEKDKEKRFSLFGKKK

SEQ ID NO: 852574 - protein, 2150 aa, Homo sapiens [sequence omitted]

SEQ ID NO: 852575 - protein, 2267 aa, Homo sapiens; identical to SEQ ID NO: 852554

SEQ ID NO: 852576 - protein, 2364 aa, Homo sapiens; identical to SEQ ID NO: 852535

SEQ ID NO: 852577 - protein, 2168 aa, Homo sapiens; identical to SEQ ID NO: 852543

SEQ ID NO: 852578 - protein, 2303 aa, Homo sapiens; identical to SEQ ID NO: 852545

SEQ ID NO: 852579 - protein, 2279 aa, Homo sapiens; identical to SEQ ID NO: 852544

SEQ ID NO: 852580 - protein, 2279 aa, Homo sapiens; identical to SEQ ID NO: 852544

SEQ ID NO: 852581 - protein, 2279 aa, Homo sapiens; identical to SEQ ID NO: 852544

SEQ ID NO: 852582 - protein, 2220 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSR

SEQ ID NO: 852583 - protein, 2237 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRNGFKKQELASSIYFLLC

SEQ ID NO: 852584 - protein, 1830 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFDDLQGVRRVYSA

SEQ ID NO: 852585 - protein, 1631 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMA

SEQ ID NO: 852586 - protein, 1277 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASSGSASRGSASSG

SEQ ID NO: 852587 - protein, 1026 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSKQVGVRILLDHHH

SEQ ID NO: 852588 - protein, 868 aa, Homo sapiens
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYKIVSSSDVGHDDYSTQSLVKKHRDVAEEIANSQDCLQPATWATIEYSTQARAQETQGRGGRDRPCHDCLLQR

SEQ ID NO: 852589 - protein, 86 aa, Homo sapiens
EYVLAHTEMPTTLEGAEAAIKKQEDFMTTMDANEEKINAVVETGRRLVSDGNINSDRIQEKVDSIDDRYSFLRFLREPCTLGLSNF

SEQ ID NO: 852590 - protein, 149 aa, Homo sapiens
MVFLTAQLWLRNRVTDRYFRIQEVLKHARHFRGRKNRCYRLAVRTVIRAFVKCTKARYLKKKNMRTLWINRITAASQEHGLKYPALIGNLVKCQVELNRKVLADLAIYEPKTFKSLAALASRRRHEGFAAALGDGKEPEGIFSRVVQYH

SEQ ID NO: 852591 - protein, 149 aa, Homo sapiens; identical to SEQ ID NO: 852590

SEQ ID NO: 852592 - protein, 187 aa, Homo sapiens
MSPRFSSPAGIGGNAPTSGGWWPGPCRLDWLFSHLQEATPSRQLSLNPKGDAHFSPGLSAPRCPYIYTAVRRPLPQPACLADPAVGAPKLSARLPSKGSWLESCGNVPFTLCQQLLGSLSGPFLRLTTYLQPAQNNQRPDHLLEMASGRPLHPHCRPSFLLASITAWPPKRSPSWPLSLCLMTATTP

SEQ ID NO: 852593 - protein, 167 aa, Homo sapiens
LTARYEAGWWARWQRRCACVVECSGRRPAGAMVFLTAQLWLRNRVTDRYFRIQEVLKHARHFRGRKNRCYRLAVRTVIRAFVKCTKARYLKKKNMRTTESRAVTQAGVQWRDLGLMQPRLPGSSDFPAPVSRVTVTAGVRHQAIFCIFSRDRVPPCWSGWSRTPDLK

SEQ ID NO: 852594 - protein, 138 aa, Homo sapiens
TNTKIRPGTVSHACNPALWEAEAGETPCPALVAEFNAQRDGPPFLLLKLWHCSLASEILCGSCRHFQVGLKGYPRPAVSSVRVVTKDPEQGVWFPGPTSGLESSLPADSTGASLTRVHIYPSASCLEVLCCATQIGFS

SEQ ID NO: 852595 - protein, 121 aa, Homo sapiens
LTARYEAGWWARWQRRCACVVECSGRRPAGAMVFLTAQLWLRNRVTDRYFRIQEVLKHARHFRGRKNRCYRLAVRTVIRAFVKCTKARYLKKKNMRTRKRGPGTPAGQRTRGPCVSAPRPS

SEQ ID NO: 852596 - protein, 149 aa, Homo sapiens; identical to SEQ ID NO: 852590

SEQ ID NO: 852597 - protein, 186 aa, Homo sapiens
LTARYEAGWWARWQRRCACVVECSGRRPAGAMVFLTAQLWLRNRVTDRYFRIQEVLKHARHFRGRKNRCYRLAVRTVIRAFVKCTKARYLKKKNMRTLWINRITAASQEHGLKYPALIGNLVKVWVSMWVPLKFWTSAETIMRGVVVLPVVPANQEAEARGSLETDFWAVVCYADGVSMLSVVSIW

SEQ ID NO: 852598 - protein, 139 aa, Homo sapiens
LTARYEAGWWARWQRRCACVVECSGRRPAGAMVFLTAQLWLRNRVTDRYFRIQEVLKHARHFRGRKNRCYRLAVRTVIRAFVKCTKARYLKKKNMRTTESRAVTQAGVQWRDLGLMQPRLPVFSKPDMQGGSLERPQQR

SEQ ID NO: 852599 - protein, 74 aa, Homo sapiens
MRVSSRGRPSGASDPAPRPGFSSGGRPAPDPTEMAPLDPQAFRDASFRDPGSLCERGHLGRVPAPLGAHRQALS

SEQ ID NO: 852600 - protein, 180 aa, Homo sapiens
LTARYEAGWWARWQRRCACVVECSGRRPAGAMVFLTAQLWLRNRVTDRYFRIQEVLKHARHFRGRKNRCYRLAVRTVIRAFVKCTKARYLKKKNMRTLWINRITAASQEHGLKYPALIGNLVKCQVELNRKVLADLAIYEPKTFKSLAALASRRRHEGFAAALGDGKEPEGIFSRVVQYH

SEQ ID NO: 852601 - protein, 150 aa, Homo sapiens
YPRDPPPTASPEGSPTPRLHPRDLPPTGSPQGSPTHRITRRLAVRTVIRAFVKCTKARYLKKKNMRTLWINRITAASQEHGLKYPALIGNLVKCQVELNRKVLADLAIYEPKTFKSLAALASRRRHEGFAAALGDGKEPEGIFSRVVQYH

SEQ ID NO: 852602 - protein, 121 aa, Homo sapiens; identical to SEQ ID NO: 852595

SEQ ID NO: 852603 - protein, 149 aa, Homo sapiens; identical to SEQ ID NO: 852590

SEQ ID NO: 852604 - protein, 149 aa, Homo sapiens; identical to SEQ ID NO: 852590

SEQ ID NO: 852605 - protein, 85 aa, Homo sapiens
LTARYEAGWWARWQRRCACVVECSGRRPAGAMVFLTAQLWLRNRVTDRYFRIQEVLKHARHFRGRKNRCYSSGLIELQLLARNMD

SEQ ID NO: 852606 - protein, 110 aa, Homo sapiens
LTARYEAGWWARWQRRCACVVECSGRRPAGAMVFLTAQLWLRNRVTDRYFRIQEVLKHARHFRGRKNRCYRLAVRTVIRAFVKCTKARYLKKKNMRTNLLDSYLWGHECS

SEQ ID NO: 852607 - protein, 1760 aa, Homo sapiens
MKVERLGLFGRGEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPKYTPTSPSYSPSSPEYTPTSPKYSPTSPKYSPTSPKYSPTSPTYSPTTPKYSPTSPTYSPTSPVYTPTSPKYSPTSPTYSPTSPKYSPTSPTYSPTSPKGSTYSPTSPGYSPTSPTYSLTSPAISPDDSDEEN

SEQ ID NO: 852608 - protein, 1197 aa, Homo sapiens
SRYRYAPRRQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPKYTPTSPSYSPSSPEYTPTSPKYSPTSPKYSPTSPKYSPTSPTYSPTTPKYSPTSPTYSPTSPVYTPTSPKYSPTSPTYSPTSPKYSPTSPTYSPTSPKGSTYSPTSPGYSPTSPTYSLTSPAISPDDSDEEN

SEQ ID NO: 852609 - protein, 2002 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGELSPSVRPGLFPPQFWVSLSIAISFVGCFPTGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPKYTPTSPSYSPSSPEYTPTSPKYSPTSPKYSPTSPKYSPTSPTYSPTTPKYSPTSPTYSPTSPVYTPTSPKYSPTSPTYSPTSPKYSPTSPTYSPTSPKGSTYSPTSPGYSPTSPTYSLTSPAISPDDSDEEN

SEQ ID NO: 852610 - protein, 708 aa, Homo sapiens
MGISSTTRSEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPKYTPTSPSYSPSSPEYTPTSPKYSPTSPKYSPTSPKYSPTSPTYSPTTPKYSPTSPTYSPTSPVYTPTSPKYSPTSPTYSPTSPKYSPTSPTYSPTSPKGSTYSPTSPGYSPTSPTYSLTSPAISPDDSDEEN

SEQ ID NO: 852611 - protein, 382 aa, Homo sapiens
MSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPKYTPTSPSYSPSSPEYTPTSPKYSPTSPKYSPTSPKYSPTSPTYSPTTPKYSPTSPTYSPTSPVYTPTSPKYSPTSPTYSPTSPKYSPTSPTYSPTSPKGSTYSPTSPGYSPTSPTYSLTSPAISPDDSDEEN

SEQ ID NO: 852612 - protein, 1908 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPKYTPTSPSYSPSSPEYTPTSPKYSPTSPKYSPTSPKYSPTSPTYSPTTPKYSPTSPTYSPTFYTNPVIVGL

SEQ ID NO: 852613 - protein, 1894 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPKYTPTSPSYSPSSPEYTPTSPKYSPTGLGLPGQVDLTQVNLTQVHLTQVDLTRSVKT

SEQ ID NO: 852614 - protein, 1834 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSFTPTP

SEQ ID NO: 852615 - protein, 237 aa, Homo sapiens
YVDWHCRDASLIILPAFQGCLDHAGTPALSITLSGKSRFSGEGASTSTPSLSLSSFSAFLGEGQVPLNPFSFTLSGKSRFSMGQEHPNPLFLHPNLLSLCPITYFYTPTSPSYSPSSPEYTPTSPKYSPTSPKYSPTSPKYSPTSPTYSPTTPKYSPTSPTYSPTSPVYTPTSPKYSPTSPTYSPTSPKYSPTSPTYSPTSPKGSTYSPTSPGYSPTSPTYSLTSPAISPDDSDEEN

SEQ ID NO: 852616 - protein, 1583 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGCRRRTPGGRG

SEQ ID NO: 852617 - protein, 1318 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNQH

SEQ ID NO: 852618 - protein, 1242 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFVTT

SEQ ID NO: 852619 - protein, 748 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNRNCERSLLVGVLWWEVV

SEQ ID NO: 852620 - protein, 694 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHECSGTSSSS

SEQ ID NO: 852621 - protein, 656 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKLVLENGDLIMAIRLYAVCEHVNGLLSGNI

SEQ ID NO: 852622 - protein, 575 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERMLNEKPQRNSIQIEARVS

SEQ ID NO: 852623 - protein, 106 aa, Homo sapiens
QVDLTAQVENKTRVCIRNGIQKFTHLSQCCVRCQRLQPRLLPCLVSHTGLPGVPRSLKPLHPFTRWCHVSQLLANVTCLRAPLSWGLHTPESLLFPHFTLLLPYLG

SEQ ID NO: 852624 - protein, 132 aa, Homo sapiens
VAGAGGDFWEGGVRGLEGGNWKGRKQEGLAWCGGKWSTLWALMAPVSPWKGHGGCGRYQPRIRRSGLELYAEWKHVNEDSQEKKILLSPERVHEIFKRISDEECFVLGMEPRYARPEWMIVTVLPVPPLSVR

SEQ ID NO: 852625 - protein, 70 aa, Homo sapiens
STWDGKVPQPAILKPRPLWTGKQIFSLIIPGHINCIRTHSTHPDDEDSGPYKHISPGDTKVGLGFWICED

SEQ ID NO: 852626 - protein, 1970 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPKYTPTSPSYSPSSPEYTPTSPKYSPTSPKYSPTSPKYSPTSPTYSPTTPKYSPTSPTYSPTSPVYTPTSPKYSPTSPTYSPTSPKYSPTSPTYSPTSPKGSTYSPTSPGYSPTSPTYSLTSPAISPDDSDEEN

SEQ ID NO: 852627 - protein, 1416 aa, Homo sapiens
MLSGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPKYTPTSPSYSPSSPEYTPTSPKYSPTSPKYSPTSPKYSPTSPTYSPTTPKYSPTSPTYSPTSPVYTPTSPKYSPTSPTYSPTSPKYSPTSPTYSPTSPKGSTYSPTSPGYSPTSPTYSLTSPAISPDDSDEEN

SEQ ID NO: 852628 - protein, 726 aa, Homo sapiens
SRGSLTPCHNLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPKYTPTSPSYSPSSPEYTPTSPKYSPTSPKYSPTSPKYSPTSPTYSPTTPKYSPTSPTYSPTSPVYTPTSPKYSPTSPTYSPTSPKYSPTSPTYSPTSPKGSTYSPTSPGYSPTSPTYSLTSPAISPDDSDEEN

SEQ ID NO: 852629 - protein, 692 aa, Homo sapiens
MDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPKYTPTSPSYSPSSPEYTPTSPKYSPTSPKYSPTSPKYSPTSPTYSPTTPKYSPTSPTYSPTSPVYTPTSPKYSPTSPTYSPTSPKYSPTSPTYSPTSPKGSTYSPTSPGYSPTSPTYSLTSPAISPDDSDEEN

SEQ ID NO: 852630 - protein, 1884 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPKYTPTSPSYSPSSPEYTPTSPKYSPTSPKYSPTSPKYSPTSPFTPTP

SEQ ID NO: 852631 - protein, 1877 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPKYTPTSPSYSPSFTDAPPSHGNDMVYISGVLLLRHRSLRC

SEQ ID NO: 852632 - protein, 1879 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPKYTPTSPSYSPSSPEYTPTSPKYSPTGLGLPGQVDLTSKIES

SEQ ID NO: 852633 - protein, 154 aa, Homo sapiens
LKEEVSKPRNKEAIIYIEQCYVKLLKLGLSKLLSNITQLFPDLTKLLPFQPTIHTTVSNLYPKLTQLQPQLAQLQPNLTQVHPNQSFLQSQLPRVYPNLSQVLTYQSQIFTHLSQVLAYQSHLFTHHPKILPNISYLFPNLSSLHPNLSQVLTY

SEQ ID NO: 852634 - protein, 1639 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTWVRSTWPGRPNYFR

SEQ ID NO: 852635 - protein, 1135 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIVSVVLFTAVFFSSFYLLTSVVSKSSPLLSTTYRIGSVGSVPPNNSSHSWRDCLYL

SEQ ID NO: 852636 - protein, 700 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIWGYSYCCVPSR

SEQ ID NO: 852637 - protein, 609 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHIRTARVRADI

SEQ ID NO: 852638 - protein, 431 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQAARCPPWWPHGTGGASHPL

SEQ ID NO: 852639 - protein, 112 aa, Homo sapiens
RCCVWRGLMGPVCSVQVDVLMEAAAHGESDPMKGVSENIMLGQLAPAGTGCFDLLLDAEKCKYGMEIPTNIPGLGAAGREYEAPAAVPACVGEAGGQAMGARVSPVHDCCSC

SEQ ID NO: 852640 - protein, 278 aa, Homo sapiens
MAALFLKRLTLQTVKSENSCIRCFGKHILQKTAPAQLSPIASAPRLSFLIHAKAFSTAEDTQNEGKKTKKNKTAFSNVGRKISQRVIHLFDEKGNDLGNMHRANVIRLMDERDLRLVQRNTSTEPAEYQLMTGLQILQERQRLREMEKANPKTGPTLRKELILSSNIGQHDLDTKTKQIQQWIKKKHLVQITIKKGKNVDVSENEMEEIFHQILQTMPGIATFSSRPQAVQGGKALMCVLRALSKNEEKAYKETQETQERDTLNKDHGNDKESNVLHQ

SEQ ID NO: 852641 - protein, 278 aa, Homo sapiens; identical to SEQ ID NO: 852640

SEQ ID NO: 852642 - protein, 278 aa, Homo sapiens; identical to SEQ ID NO: 852640

SEQ ID NO: 852643 - protein, 278 aa, Homo sapiens; identical to SEQ ID NO: 852640

SEQ ID NO: 852644 - protein, 208 aa, Homo sapiens
MAALFLKRLTLQTVKSENSCIRCFGKHILQKTAPAQLSPIASAPRLSFLIHAKAFSTAEDTQNEGKKTKKNKTAFSNVGRKISQRVIHLFDEKGNDLGNMHRANVIRLMDERDLRLVQRNTSTEPAEYQLMTGLQILQERQRLREMEKANPKTGPTLRKELILSSNIGQHDLDTKTKQIQQWIKKKHLVQITIKKGKNVDVSENEMQK

SEQ ID NO: 852645 - protein, 278 aa, Homo sapiens; identical to SEQ ID NO: 852640

SEQ ID NO: 852646 - protein, 210 aa, Homo sapiens
MQKPLVPLKTPRMKEKRQKRIKQLLVTLEEKMHRANVIRLMDERDLRLVQRNTSTEPAEYQLMTGLQILQERQRLREMEKANPKTGPTLRKELILSSNIGQHDLDTKTKQIQQWIKKKHLVQITIKKGKNVDVSENEMEEIFHQILQTMPGIATFSSRPQAVQGGKALMCVLRALSKNEEKAYKETQETQERDTLNKDHGNDKESNVLHQ

SEQ ID NO: 852647 - protein, 174 aa, Homo sapiens [sequence omitted]

SEQ ID NO: 852648 - protein, 278 aa, Homo sapiens; identical to SEQ ID NO: 852640

SEQ ID NO: 852649 - protein, 249 aa, Homo sapiens
MAALFLKRLTLQTVKSENSCIRCFGKHILQKTAPAQLSPIASAPRLSFLIHAKAFSTAEDTQNEGKKTKKNKTAFSNVGRKISQRVIHLFDEKGNDLGNMHRANVIRLMDERDLRLVQRNTSTEPAEYQLMTGLQILQERQRLREMEKANPKTGPTLRKELILSSNIGQHDLDTKTKQIQQWIKKKHLVQITIKKGKNVDVSENEMREIFSFQIIQNMAWISTFLILGHKLSRGESFSVSPGLGTRGEV

SEQ ID NO: 852650 - protein, 278 aa, Homo sapiens; identical to SEQ ID NO: 852640

SEQ ID NO: 852651 - protein, 278 aa, Homo sapiens; identical to SEQ ID NO: 852640

SEQ ID NO: 852652 - protein, 208 aa, Homo sapiens; identical to SEQ ID NO: 852644

SEQ ID NO: 852653 - protein, 278 aa, Homo sapiens; identical to SEQ ID NO: 852640

SEQ ID NO: 852654 - protein, 174 aa, Homo sapiens [sequence omitted]

SEQ ID NO: 852655 - protein, 863 aa, Homo sapiens
DRAAEDAEVVAAAFEQVSEPPSETPALGTGGRRASGPLKALRRRGDTMAEPLKEEDGEDGSAEPPGPVKAEPAHTAASVAAKNLALLKARSFDVTFDVGDEYEIIETIGNGAYGVVSSARRRLTGQQVAIKKIPNAFDVVTNAKRTLRELKILKHFKHDNIIAIKDILRPTVPYGEFKSVYVVLDLMESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVASEPGCPDVEMPSPWAPSGDCAMESPPPAPPPCPGPAPDTIDLTLQPPPPVSEPAPPKKDGAISDNTKAALKAALLKSLRSRLRDGPSAPLEAPEPRKPVTAQERQREREEKRRRRQERAKEREKRRQERERKERGAGASGGPSTDPLAGLVLSDNDRSLLERWTRMARPAAPALTSVPAPAPAPTPTPTPVQPTSPPPGPVAQPTGPQPQSAGSTSGPVPQPACPPPGPAPHPTGPPGPIPVPAPPQIATSTSLLAAQSLVPPPGLPGSSTPGVLPYFPPGLPPPDAGGAPQSSMSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLADLPDLQDP

SEQ ID NO: 852656 - protein, 816 aa, Homo sapiens
MAEPLKEEDGEDGSAEPPGPVKAEPAHTAASVAAKNLALLKARSFDVTFDVGDEYEIIETIGNGAYGVVSSARRRLTGQQVAIKKIPNAFDVVTNAKRTLRELKILKHFKHDNIIAIKDILRPTVPYGEFKSVYVVLDLMESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVASEPGCPDVEMPSPWAPSGDCAMESPPPAPPPCPGPAPDTIDLTLQPPPPVSEPAPPKKDGAISDNTKAALKAALLKSLRSRLRDGPSAPLEAPEPRKPVTAQERQREREEKRRRRQERAKEREKRRQERERKERGAGASGGPSTDPLAGLVLSDNDRSLLERWTRMARPAAPALTSVPAPAPAPTPTPTPVQPTSPPPGPVAQPTGPQPQSAGSTSGPVPQPACPPPGPAPHPTGPPGPIPVPAPPQIATSTSLLAAQSLVPPPGLPGSSTPGVLPYFPPGLPPPDAGGAPQSSMSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLADLPDLQDP

SEQ ID NO: 852657 - protein, 699 aa, Homo sapiens
TGQLKTRRWWLRPLNNYVVLDLMESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVASEPGCPDVEMPSPWAPSGDCAMESPPPAPPPCPGPAPDTIDLTLQPPPPVSEPAPPKKDGAISDNTKAALKAALLKSLRSRLRDGPSAPLEAPEPRKPVTAQERQREREEKRRRRQERAKEREKRRQERERKERGAGASGGPSTDPLAGLVLSDNDRSLLERWTRMARPAAPALTSVPAPAPAPTPTPTPVQPTSPPPGPVAQPTGPQPQSAGSTSGPVPQPACPPPGPAPHPTGPPGPIPVPAPPQIATSTSLLAAQSLVPPPGLPGSSTPGVLPYFPPGLPPPDAGGAPQSSMSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLADLPDLQDP

SEQ ID NO: 852658 - protein, 863 aa, Homo sapiens; identical to SEQ ID NO: 852655

SEQ ID NO: 852659 - protein, 237 aa, Homo sapiens
YIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVASEPGCPDVEMPSPWAPSGDCAMESPPPAPPPCPGPAPDTIDLTLQPPPPVSEPAPPKKDGAISDNTKAALKAALLKSLRSRLRGALWAGRVGRGETWTWTRLQAFTFSPAQLPRRWPQRTPGGS

SEQ ID NO: 852660 - protein, 677 aa, Homo sapiens
MESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVASEPGCPDVEMPSPWAPSGDCAMESPPPAPPPCPGPAPDTIDLTLQPPPPVSEPAPPKKDGAISDNTKAALKAALLKSLRSRLRDGPSAPLEAPEPRKPVTAQERQREREEKRRRRQERAKEREKRRQERERKERGAGASGGPSTDPLAGLVLSDNDRSLLERWTRMARPAAPALTSVPAPAPAPTPTPTPVQPTSPPPGPVAQPTGPQPQSAGSTSGPVPQPACPPPGPAPHPTGPPGPIPVPAPPQIATSTSLLAAQSLVPPPGLPGSSTPGVLPYFPPGLPPPDAGGAPQSSMSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLADLPDLQDP

SEQ ID NO: 852661 - protein, 816 aa, Homo sapiens; identical to SEQ ID NO: 852656

SEQ ID NO: 852662 - protein, 677 aa, Homo sapiens; identical to SEQ ID NO: 852660

SEQ ID NO: 852663 - protein, 93 aa, Homo sapiens
SFSPEETPLGSPAVLLCSIASHLLTQQLAMLERAEQAQARTPTCMPTDMQACTHTHAHGYTHTLRLPSPGPDLTLLALLPAQWCNGKVSSSHP

SEQ ID NO: 852664 - protein, 303 aa, Homo sapiens
MARGKAKEEGSWKKFIWNSEKKEFLGRTGGSWFKILLFYVIFYGCLAGIFIGTIQVMLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGFKPKPPKNESLETYPVMKYNPNVLPVQCTGKRDEDKDKVGNVEYFGLGNSPGFPLQYYPYYGKLLQPKYLQPLLAVQFTNLTMDTEIRIECKAYGENIGYSEKDRFQGRFDVKIEVKS

SEQ ID NO: 852665 - protein, 303 aa, Homo sapiens; identical to SEQ ID NO: 852664

SEQ ID NO: 852666 - protein, 303 aa, Homo sapiens; identical to SEQ ID NO: 852664

SEQ ID NO: 852667 - protein, 303 aa, Homo sapiens; identical to SEQ ID NO: 852664

SEQ ID NO: 852668 - protein, 303 aa, Homo sapiens; identical to SEQ ID NO: 852664

SEQ ID NO: 852669 - protein, 303 aa, Homo sapiens; identical to SEQ ID NO: 852664

SEQ ID NO: 852670 - protein, 303 aa, Homo sapiens; identical to SEQ ID NO: 852664

SEQ ID NO: 852671 - protein, 303 aa, Homo sapiens; identical to SEQ ID NO: 852664

SEQ ID NO: 852672 - protein, 303 aa, Homo sapiens; identical to SEQ ID NO: 852664

SEQ ID NO: 852673 - protein, 319 aa, Homo sapiens
MARGKAKEEGSWKKFIWNSEKKEFLGRTGGSWFKILLFYVIFYGCLAGIFIGTIQVMLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGFKPKPPKNESLETYPVMKYNPNVLPVQCTGKRDEDKDKVGNVEYFGLGNSPGFPLQYYPYYGKILEPKYLSPCWPYYGKLLQPKYLQPLLAVQFTNLTMDTEIRIECKAYGENIGYSEKDRFQGRFDVKIEVKS

SEQ ID NO: 852674 - protein, 304 aa, Homo sapiens
MARGKAKEEGSWKKFIWNSEKKEFLGRTGGSWFKILLFYVIFYGCLAGIFIGTIQVMLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGFKPKPPKNESLETYPVMKYNPNVLPVQCTGKRDEDKDKVGNVEYFGLGNSPGFPLQYYPYYGKLLQPKYLQPLLAVQFTNLTMDTEIRIECKAYGENIGYSEKDRFQGRFDVKIGGTAL

SEQ ID NO: 852675 - protein, 256 aa, Homo sapiens
MARGKAKEEGSWKKFIWNSEKKEFLGRTGGSWFKILLFYVIFYGCLAGIFIGTIQVMLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGFKPKPPKNESLETYPVMKYNPNVLPVQCTGKWTGQLPWFSSAVLSVLWQTPAAQIPAAPAGRTVHQSYHGH

SEQ ID NO: 852676 - protein, 303 aa, Homo sapiens; identical to SEQ ID NO: 852664

SEQ ID NO: 852677 - protein, 227 aa, Homo sapiens
MARGKAKEEGSWKKFIWNSEKKEFLGRTGGSWFKILLFYVIFYGCLAGIFIGTIQVMLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGFKPKPPKNESLETYPVMKYNPNVLPVQCTGKTSRIRYRARFD

SEQ ID NO: 852678 - protein, 198 aa, Homo sapiens [sequence omitted]

SEQ ID NO: 852679 - protein, 113 aa, Homo sapiens
MARGKAKEEGSWKKFIWNSEKKEFLGRTGGSWFKILLFYVIFYGCLAGIFIGTIQVMLLTISEFKPTYQDRVAPPGKIHMNSFISFRDSMGVTFSIEKKFFGKLLYNVVLKQP

SEQ ID NO: 852680 - protein, 190 aa, Homo sapiens
SRLRATQVRIPQPRKGRFTPSRELGGGCAALPARPSPPPPPPPRPAPNAPRPAIQAAPLAPAAPLCRPRTRPLGPSPCPWRRRLATGPLEGGAHGRRGAVYSKGRAGAAEFLGSWRECRWRPAVRLSVLPSLTLLPRACLCRGQGRRGPSTRPQWQRERQLRVRGAPDPPRARGALGGPKKARERLRAHQ

SEQ ID NO: 852681 - protein, 303 aa, Homo sapiens; identical to SEQ ID NO: 852664

SEQ ID NO: 852682 - protein, 303 aa, Homo sapiens; identical to SEQ ID NO: 852664

SEQ ID NO: 852683 - protein, 303 aa, Homo sapiens; identical to SEQ ID NO: 852664

SEQ ID NO: 852684 - protein, 303 aa, Homo sapiens; identical to SEQ ID NO: 852664

SEQ ID NO: 852685 - protein, 303 aa, Homo sapiens; identical to SEQ ID NO: 852664

SEQ ID NO: 852686 - protein, 303 aa, Homo sapiens; identical to SEQ ID NO: 852664

SEQ ID NO: 852687 - protein, 303 aa, Homo sapiens; identical to SEQ ID NO: 852664

SEQ ID NO: 852688 - protein, 303 aa, Homo sapiens; identical to SEQ ID NO: 852664

SEQ ID NO: 852689 - protein, 183 aa, Homo sapiens
MIFEDCGDVPSEPKERGDFNHERGERKVCRFKLEWLGNCSGLNDETYGYKEGKPCIIIKLNRVLGFKPKPPKNESLETYPVMKYNPNVLPVQCTGKRDEDKDKVGNVEYFGLGNSPGFPLQYYPYYGKLLQPKYLQPLLAVQFTNLTMDTEIRIECKAYGENIGYSEKDRFQGRFDVKIEVKS

SEQ ID NO: 852690 - protein, 114 aa, Homo sapiens
MARGKAKEEGSWKKFIWNSEKKEFLGRTGGSWFKILLFYVIFYGCLAGIFIGTIQVMLLTISEFKPTYQDRVAPPGLTQIPQIQKTEISFRPNDPKSYEAYVLNIVRFLEKCAQ

SEQ ID NO: 852691 - protein, 183 aa, Homo sapiens; identical to SEQ ID NO: 852689

SEQ ID NO: 852692 - protein, 288 aa, Homo sapiens
MARGKAKEEGSWKKFIWNSEKKEFLGRTGGSWFKILLFYVIFYGCLAGIFIGTIQVMLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGFKPKPPKNESLETYPVMKYNPNVLPVQCTGKRDEDKDKVGNVEYFGLGNSPGFPLQYYPYYGKLLQPKYLQPLLAVQFTNLTMDTEIRIECKAHITSVPSSIV

SEQ ID NO: 852693 - protein, 106 aa, Homo sapiens
MIQFSSDLNIRVPRSVHWQRDEDKDKVGNVEYFGLGNSPGFPLQYYPYYGKLLQPKYLQPLLAVQFTNLTMDTEIRIECKAYGENIGYSEKDRFQGRFDVKIEVKS

SEQ ID NO: 852694 - protein, 153 aa, Homo sapiens [sequence omitted]

SEQ ID NO: 852695 - protein, 153 aa, Homo sapiens [sequence omitted]

SEQ ID NO: 852696 - protein, 153 aa, Homo sapiens [sequence omitted]

SEQ ID NO: 852697 - protein, 153 aa, Homo sapiens [sequence omitted]

SEQ ID NO: 852698 - protein, 196 aa, Homo sapiens
VLHVPFPTHVPLPTHVRSQRMCRSQRMCRSQRMCRSQRMCRSQRMCRSQRMCRSQRMCRFPTHVPLPTFALPVVGMWEAHLSSCDFMSQTKDERLVSAMMVVSEAFPCPVWCLPHIVPDTGFLDPLLLSFLSFRSRSPVLYPAPQKPQCFSSAGLGHKEALGYGERLLLPRVYSQARGLPSSSQTSLKGSPFGAGR

SEQ ID NO: 852699 - protein, 153 aa, Homo sapiens [sequence omitted]

SEQ ID NO: 852700 - protein, 153 aa, Homo sapiens [sequence omitted]

SEQ ID NO: 852701 - protein, 153 aa, Homo sapiens [sequence omitted]

SEQ ID NO: 852702 - protein, 153 aa, Homo sapiens [sequence omitted]

SEQ ID NO: 852703 - protein, 153 aa, Homo sapiens [sequence omitted]

SEQ ID NO: 852704 - protein, 168 aa, Homo sapiens
EPFTRCCAQCPSISRLRAEDCFSSLLQGLVTEPARGATMRQKAVSLFLCYLLLFTCSGVEAGKKKCSESSDSGSGFWKALTFMAVGGGLAVAGLPALGFTGAGIAANSVAASLMSWSAILNGGGVPAGGLVATLQSLGAGGSSVVIGNIGALMGYATHKYLDSEEDEE

SEQ ID NO: 852705 - protein, 297 aa, Homo sapiens
LGPITGPQGTPPHQPRGGIPRARRWKASRPATQDPVTPARNSCPLQHSPARPLGFKELQEALGIQPRSPRQRLGPLPQLGPPGSGEGSAPPESPGCVVPESPGPRGADGRYDGGESRAPDLADPVAGGGRPAGRQPDQGPSISRLRAEDCFSSLLQGLVTEPARGATMRQKAVSLFLCYLLLFTCSGVEAGKKKCSESSDSGSGFWKALTFMAVGGGLAVAGLPALGFTGAGIAANSVAASLMSWSAILNGGGVPAGGLVATLQSLGAGGSSVVIGNIGALMGYATHKYLDSEEDEE

SEQ ID NO: 852706 - protein, 196 aa, Homo sapiens
MRGNEITVDLDELGTVGHPECSWNGPAPFIGPSAHGGTSTSPPRGVPRSSCAFHPSRPCSRRPNSRVLAVARIQAWLLRFLETGEAVQCPRQLRRAKVGPTGLATKASSSGLVLGPSHVRSRYSYGSTHFVFAPLDLGALSVPTPYLNGNFFRSQLDARRFEGTLGPDKVFLQEDATYLSFLVGLKLLPRLGLSDT

SEQ ID NO: 852707 - protein, 110 aa, Homo sapiens
MDAGKKKCSESSDSGSGFWKALTFMAVGGGLAVAGLPALGFTGAGIAANSVAASLMSWSAILNGGGVPAGGLVATLQSLGAGGSSVVIGNIGALMGYATHKYLDSEEDEE

SEQ ID NO: 852708 - protein, 168 aa, Homo sapiens; identical to SEQ ID NO: 852704

SEQ ID NO: 852709 - protein, 297 aa, Homo sapiens; identical to SEQ ID NO: 852705

SEQ ID NO: 852710 - protein, 297 aa, Homo sapiens; identical to SEQ ID NO: 852705

SEQ ID NO: 852711 - protein, 96 aa, Homo sapiens
FCPGSQCCVEDGPESIDSIIDMDAVCKRVTTLGLDVSVTISQDAGSLGSQKSKVKVVAGLVPSGGAEGKNPSLPKVTVFSAAEGGPGPSRLSVASP

SEQ ID NO: 852712 - protein, 109 aa, Homo sapiens
FCPGSQCCVEDGPESIDSIIDMDAVCKRVTTLGLDVSVTISQDAGRKKPFPAKGDCVFCRRRRARSLQAQCGFSLTPALELLPVPFLKLLCPGPPRRRRICRILPGAGL

SEQ ID NO: 852713 - protein, 26 aa, Homo sapiens
MAVEGQALPSAHVWKANSRVDAEHTC

SEQ ID NO: 852714 - protein, 108 aa, Homo sapiens
RCWTSWSSQRAKSTIATNTEGRSGLLRPHPAGDPTRGHPPSGVWPGKDKLFSLGIRSGREILICPPPLPPSLQKLRLIRGKNPSLPKVTVFSAAEGGPGPSRLSVASP

SEQ ID NO: 852715 - protein, 91 aa, Homo sapiens
GMAREDEFNLGELTTLHGFLSCLKFLSRKKPFPAKGDCVFCRRRRARSLQAQCGFSLTPALELLPVPFLKLLCPGPPRRRRICRILPGAGL

SEQ ID NO: 852716 - protein, 82 aa, Homo sapiens
RCWTSWSSQRAKSTIATNTEGRSGLLRPHPAGDPTRGHPPSGVWPGKDKLFSLGIRSGREILICPPPLPPSLQKLRLIRGKW

SEQ ID NO: 852717 - protein, 26 aa, Homo sapiens
MAVEGQALPSAHVWKANSRVDAEHTC

SEQ ID NO: 852718 - protein, 115 aa, Homo sapiens
MDKMRRDRDKSILLCFQETSSCLSGDGATTGGPGRLESGMKENSASSLLSKPRGRLRLKRSRMEEGIGTHLQTSTVSRKFGSIPSPRTHQPRSWQNPLTNQENTDPVCLLTTEWN

SEQ ID NO: 852719 - protein, 109 aa, Homo sapiens
GSRFPCQPPAVSSPSPASAEIPGPIETRTSLSATASHASAAGNPAISAPAEKVPGCRRRRREREERLGGSPGRGVVRLRERPGCGHTGLVNSHLLGSCSRTHSLPHPLF

SEQ ID NO: 852720 - protein, 105 aa, Homo sapiens
MDKMRRDRDKSILLCFQETSSCLSGDGATTGGPGRLESGMKENSASSLLSKPRGPGDNLRALKCFNTMYQLDFSTCPLDCPKAKSQRGQGPSRAGSLRASYRAAP

SEQ ID NO: 852721 - protein, 176 aa, Homo sapiens
MPHPCALGLWTQQLPSLPTERDYHSLCERQPIGRLLFREFCATRPELSRCVAFLDGVAEYEVTPDDKRKACGRQLTQNFLSHTGPDLIPEVPRQLVTNCTQRLEQGPCKDLFQELTRLTHEYLSVAPFADYLDSIYFNRFLQWKWLERQPVTKNTFRQYRVLGKGGFGEVSGQARA

SEQ ID NO: 852722 - protein, 576 aa, Homo sapiens
MELENIVANTVLLKAREGGGGNRKGKSKKWRQMLQFPHISQCEELRLSLERDYHSLCERQPIGRLLFREFCATRPELSRCVAFLDGVAEYEVTPDDKRKACGRQLTQNFLSHTGPDLIPEVPRQLVTNCTQRLEQGPCKDLFQELTRLTHEYLSVAPFADYLDSIYFNRFLQWKWLERQPVTKNTFRQYRVLGKGGFGEVCACQVRATGKMYACKKLEKKRIKKRKGEAMALNEKQILEKVNSRFVVSLAYAYETKDALCLVLTLMNGGDLKFHIYHMGQAGFPEARAVFYAAEICCGLEDLHRERIVYRDLKPENILLDDHGHIRISDLGLAVHVPEGQTIKGRVGTVGYMAPEVVKNERYTFSPDWWALGCLLYEMIAGQSPFQQRKKKIKREEVERLVKEVPEEYSERFSPQARSLCSQLLCKDPAERLGCRGGSAREVKEHPLFKKLNFKRLGAGMLEPPFKPDPQAIYCKDVLDIEQFSTVKGVELEPTDQDFYQKFATGSVPIPWQNEMVETECFQELNVFGLDGSVPPDLDWKGQPPAPPKKGLLQRLFSRQDCCGNCSDSEEELPTRL

SEQ ID NO: 852723 - protein, 544 aa, Homo sapiens
MLQFPHISQCEELRLSLERDYHSLCERQPIGRLLFREFCATRPELSRCVAFLDGVAEYEVTPDDKRKACGRQLTQNFLSHTGPDLIPEVPRQLVTNCTQRLEQGPCKDLFQELTRLTHEYLSVAPFADYLDSIYFNRFLQWKWLERQPVTKNTFRQYRVLGKGGFGEVCACQVRATGKMYACKKLEKKRIKKRKGEAMALNEKQILEKVNSRFVVSLAYAYETKDALCLVLTLMNGGDLKFHIYHMGQAGFPEARAVFYAAEICCGLEDLHRERIVYRDLKPENILLDDHGHIRISDLGLAVHVPEGQTIKGRVGTVGYMAPEVVKNERYTFSPDWWALGCLLYEMIAGQSPFQQRKKKIKREEVERLVKEVPEEYSERFSPQARSLCSQLLCKDPAERLGCRGGSAREVKEHPLFKKLNFKRLGAGMLEPPFKPDPQAIYCKDVLDIEQFSTVKGVELEPTDQDFYQKFATGSVPIPWQNEMVETECFQELNVFGLDGSVPPDLDWKGQPPAPPKKGLLQRLFSRQDCCGNCSDSEEELPTRL

SEQ ID NO: 852724 - protein, 576 aa, Homo sapiens; identical to SEQ ID NO: 852722

SEQ ID NO: 852725 - protein, 505 aa, Homo sapiens
MELENIVANTVLLKAREGGGGNRKGKSKKWRQMLQFPHISQCEELRLSLERDYHSLCERQPIGRLLFREFCATRPELSRCVAFLDGVAEYEVTPDDKRKACGRQLTQNFLSHTGPDLIPEVPRQLVTNCTQRLEQGPCKDLFQELTRLTHEYLSVAPFADYLDSIYFNRFLQWKWLERQPVTKNTFRQYRVLGKGGFGEVCACQVRATGKMYACKKLEKKRIKKRKGEAMALNEKQILEKVNSRFVVSLAYAYETKDALCLVLTLMNGGDLKFHIYHMGQAGFPEARAVFYAAEICCGLEDLHRERIVYRDLKPENILLDDHGHIRISDLGLAVHVPEGQTIKGRVGTVGYMAPEVVKNERYTFSPDWWALGCLLYEMIAGQSPFQQRKKKIKREEVERLVKEVPEEYSERFSPQARSLCSQLLCKDPAERLGCRGGSAREVKEHPLFKKLNFKRLGAGMLEPPFKPDPQAIYCKDVLDIEQFSTVKGVELEPTDQDFHCPGRPR

SEQ ID NO: 852726 - protein, 402 aa, Homo sapiens
MELENIVANTVLLKAREGGGGNRKGKSKKWRQMLQFPHISQCEELRLSLERDYHSLCERQPIGRLLFREFCATRPELSRCVAFLDGVAEYEVTPDDKRKACGRQLTQNFLSHTGPDLIPEVPRQLVTNCTQRLEQGPCKDLFQELTRLTHEYLSVAPFADYLDSIYFNRFLQWKWLERQPVTKNTFRQYRVLGKGGFGEVCACQVRATGKMYACKKLEKKRIKKRKGEAMALNEKQILEKVNSRFVVSLAYAYETKDALCLVLTLMNGGDLKFHIYHMGQAGFPEARAVFYAAEICCGLEDLHRERIVYRDLKPENILLDDHGPGPSLGQRCVPSALLRGARGFLYLCICTNVYSDQSILNSRRRPGAPALAPGGSQPWLGERELAEEPLPNSRLLWPSLDG

SEQ ID NO: 852727 - protein, 176 aa, Homo sapiens
RAAPSRADRHPASALARDPGRRRGPAGQAAPQPMELENIVANTVLLKAREGEAAGWAAGPGCVERECAASELRRATQPSDPLGPRALRLTPRPDTSLSGPSSSSSAPAPGIRGPGRGGGQAAALAAGGGEGVKEGETKREGWDRSPRRACLRGKPPPGERCKDAPRARGPDPSTLA

SEQ ID NO: 852728 - protein, 576 aa, Homo sapiens; identical to SEQ ID NO: 852722

SEQ ID NO: 852729 - protein, 576 aa, Homo sapiens; identical to SEQ ID NO: 852722

SEQ ID NO: 852730 - protein, 560 aa, Homo sapiens
MELENIVANTVLLKAREGGGGNRKGKSKKWRQMLQFPHISQCEELRLSLERDYHSLCERQPIGRLLFREFCATRPELSRCVAFLDGVAEYEVTPDDKRKACGRQLTQNFLSHTGPDLIPEVPRQLVTNCTQRLEQGPCKDLFQELTRLTHEYLSVAPFADYLDSIYFNRFLQWKWLERQPVTKNTFRQYRVLGKGGFGEVCACQVRATGKMYACKKLEKKRIKKRKGEAMALNEKQILEKVNSRFVVSLAYAYETKDALCLVLTLMNGGDLKFHIYHMGQAGFPEARAVFYAAEICCGLEDLHRERIVYRDLKPENILLDDHGHIRISDLGLAVHVPEGQTIKGRVGTVGYMAPEVVKNERYTFSPDWWALGCLLYEMIAGQSPFQQRKKKIKREEVERLVKEVPEEYSERFSPQARSLCSQLLCKDPAERLGCRGGSAREVKEHPLFKKLNFKRLGAGMLEPPFKPDPQAIYCKDVLDIEQFSTVKGVELEPTDQDFYQKFATGSVPIPWQNEMVETECFQELNVFGLDGSVPPDLDWKGQPPAPPKKGLLQRLFSRQR

SEQ ID NO: 852731 - protein, 475 aa, Homo sapiens
MELENIVANTVLLKAREGGGGNRKGKSKKWRQMLQFPHISQCEELRLSLERDYHSLCERQPIGRLLFREFCATRPELSRCVAFLDGVAEYEVTPDDKRKACGRQLTQNFLSHTGPDLIPEVPRQLVTNCTQRLEQGPCKDLFQELTRLTHEYLSVAPFADYLDSIYFNRFLQWKWLERQPVTKNTFRQYRVLGKGGFGEVCACQVRATGKMYACKKLEKKRIKKRKGEAMALNEKQILEKVNSRFVVSLAYAYETKDALCLVLTLMNGGDLKFHIYHMGQAGFPEARAVFYAAEICCGLEDLHRERIVYRDLKPENILLDDHGHIRISDLGLAVHVPEGQTIKGRVGTVGYMAPEVVKNERYTFSPDWWALGCLLYEMIAGQSPFQQRKKKIKREEVERLVKEVPEEYSERFSPQARSLCSQLLCKDPAERLGCRGGSAREVKEHPLFKKLNFKRLGAGMLEPPFKPDVSAAHSC

SEQ ID NO: 852732 - protein, 420 aa, Homo sapiens
MELENIVANTVLLKAREGGGGNRKGKSKKWRQMLQFPHISQCEELRLSLERDYHSLCERQPIGRLLFREFCATRPELSRCVAFLDGVAEYEVTPDDKRKACGRQLTQNFLSHTGPDLIPEVPRQLVTNCTQRLEQGPCKDLFQELTRLTHEYLSVAPFADYLDSIYFNRFLQWKWLERQPVTKNTFRQYRVLGKGGFGEVCACQVRATGKMYACKKLEKKRIKKRKGEAMALNEKQILEKVNSRFVVSLAYAYETKDALCLVLTLMNGGDLKFHIYHMGQAGFPEARAVFYAAEICCGLEDLHRERIVYRDLKPENILLESQPVTKYTFRQYRVLGKGGFGEVCPCPVRATGKMYACKKLEKKRIKKRKGEALALNEKQILEKVNSRFVVSLAYAYETKDAVCLVLTLMNGATQVPQSVL

SEQ ID NO: 852733 - protein, 143 aa, Homo sapiens
MELENIVANTVLLKAREGGGGNRKGKSKKWRQMLQFPHISQCEELRLSLERDYHSLCERQPIGRLLFREFCATRPELSRCVAFLDGVAEYEVTPDDKRKACGRQLTQNFLSHTGPDLIPESYSSASFCVCVHVCVSRGILLRK

SEQ ID NO: 852734 - protein, 483 aa, Homo sapiens
MSGGGPSGGGPGGSGRARTSSFAEPGGGGGGGGGGPGGSASGPGGTGGGKASVGAMGGGVGASSSGGGPGGSGGGGSGGPGAGTSFPPPGVKLGRDSGKVTTVVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVKVYMYQLFRSLAYIHSQGVCHRDIKPQNLLVDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFKSRTPPEAIALCSSLLEYTPSSRLSPLEACAHSFFDELRCLGTQLPNNRPLPPLFNFSAGELSIQPSLNAILIPPHLRSPAGTTTLTPSSQALTETPTSSDWQSTDATPTLTNSS

SEQ ID NO: 852735 - protein, 383 aa, Homo sapiens
MSGGGPSGGGPGGSGRARTSSFAEPGGGGGGGGGGPGGSASGPGGTGGGKASVGAMGGGVGASSSGGGPGGSGGGGSGGPGAGTSFPPPGVKLGRDSGKVTTVVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVKVYMYQLFRSLAYIHSQGVCHRDIKPQNLLVDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKGSILKQQSKGSVYVGTT

SEQ ID NO: 852736 - protein, 158 aa, Homo sapiens
VAWPRCTVAVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVRCTCTSSSATVRRARRTSCASKLYIYKTNSG

SEQ ID NO: 852737 - protein, 396 aa, Homo sapiens
MKTPADTGDSGKVTTVVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVKVYMYQLFRSLAYIHSQGVCHRDIKPQNLLVDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFKSRTPPEAIALCSSLLEYTPSSRLSPLEACAHSFFDELRCLGTQLPNNRPLPPLFNFSAGELSIQPSLNAILIPPHLRSPAGTTTLTPSSQALTETPTSSDWQSTDATPTLTNSS

SEQ ID NO: 852738 - protein, 389 aa, Homo sapiens
VAWPRCTVAVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVKVYMYQLFRSLAYIHSQGVCHRDIKPQNLLVDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFKSRTPPEAIALCSSLLEYTPSSRLSPLEACAHSFFDELRCLGTQLPNNRPLPPLFNFSAGELSIQPSLNAILIPPHLRSPAGTTTLTPSSQALTETPTSSDWQSTDATPTLTNSS

SEQ ID NO: 852739 - protein, 280 aa, Homo sapiens
MRSGAALHKAVTSLILYVEVYMYQLFRSLAYIHSQGVCHRDIKPQNLLVDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFKSRTPPEAIALCSSLLEYTPSSRLSPLEACAHSFFDELRCLGTQLPNNRPLPPLFNFSAGELSIQPSLNAILIPPHLRSPAGTTTLTPSSQALTETPTSSDWQSTDATPTLTNSS

SEQ ID NO: 852740 - protein, 483 aa, Homo sapiens; identical to SEQ ID NO: 852734

SEQ ID NO: 852741 - protein, 137 aa, Homo sapiens
MNPNYTEFKFPQIKAHPWTKVFKSRTPPEAIALCSSLLEYTPSSRLSPLEACAHSFFDELRCLGTQLPNNRPLPPLFNFSAGELSIQPSLNAILIPPHLRSPAGTTTLTPSSQALTETPTSSDWQSTDATPTLTNSS

SEQ ID NO: 852742 - protein, 483 aa, Homo sapiens; identical to SEQ ID NO: 852734

SEQ ID NO: 852743 - protein, 483 aa, Homo sapiens; identical to SEQ ID NO: 852734

SEQ ID NO: 852744 - protein, 168 aa, Homo sapiens
LSGWALVSSFGRWGCGKQPVITCRRHCGSEITGVCQCPGHLTLMSPAPIPQVFKSRTPPEAIALCSSLLEYTPSSRLSPLEACAHSFFDELRCLGTQLPNNRPLPPLFNFSAGELSIQPSLNAILIPPHLRSPAGTTTLTPSSQALTETPTSSDWQSTDATPTLTNSS

SEQ ID NO: 852745 - protein, 263 aa, Homo sapiens
MSGGGPSGGGPGGSGRARTSSFAEPGGGGGGGGGGPGGSASGPGGTGGGKASVGAMGGGVGASSSGGGPGGSGGGGSGGPGAGTSFPPPGVKLGRDSGKVTTVVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVKVYMYQLFRSLAYIHSQGVCHRDIKPQNLPGGPGEWRELLMS

SEQ ID NO: 852746 - protein, 87 aa, Homo sapiens
TSSPRTCWWTLTLLSSSSAILAGGPGACWVAEEAGGTPTLASRVPLPISSHSAKQLVRGEPNVSYICSRYYRAPELIFGATDYTSSI

SEQ ID NO: 852747 - protein, 102 aa, Homo sapiens
MSGGGPSGGGPGGSGRARTSSFAEPGGGGGGGGGGPGGSASGPGGTGGGKASVGAMGGGVGASSSGGGPGGSGGGGSGGPGAGTSFPPPGVKLGREYYVAPV

SEQ ID NO: 852748 - protein, 484 aa, Homo sapiens
MRRLWGQSVEPLDSLCFPGSGSGRPWLRTGSCEDQMNGRLQKVTGTFTTITHWEQDSRFYSPLDHSLRLIEDCGVVYQARLAEIQGWIVYPLCSPGDSGKVTTVVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVKVYMYQLFRSLAYIHSQGVCHRDIKPQNLLVDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFKSRTPPEAIALCSSLLEYTPSSRLSPLEACAHSFFDELRCLGTQLPNNRPLPPLFNFSAGELSIQPSLNAILIPPHLRSPAGTTTLTPSSQALTETPTSSDWQSTDATPTLTNSS

SEQ ID NO: 852749 - protein, 483 aa, Homo sapiens; identical to SEQ ID NO: 852734

SEQ ID NO: 852750 - protein, 483 aa, Homo sapiens; identical to SEQ ID NO: 852734

SEQ ID NO: 852751 - protein, 483 aa, Homo sapiens; identical to SEQ ID NO: 852734

SEQ ID NO: 852752 - protein, 483 aa, Homo sapiens; identical to SEQ ID NO: 852734

SEQ ID NO: 852753 - protein, 370 aa, Homo sapiens
MSGGGPSGGGPGGSGRARTSSFAEPGGGGGGGGGGPGGSASGPGGTGGGKASVGAMGGGVGASSSGGGPGGSGGGGSGGPGAGTSFPPPGVKLGRDSGKVTTVVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVKVYMYQLFRSLAYIHSQGVCHRDIKPQNLLVDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVGQG

SEQ ID NO: 852754 - protein, 252 aa, Homo sapiens
MSGGGPSGGGPGGSGRARTSSFAEPGGGGGGGGGGPGGSASGPGGTGGGKASVGAMGGGVGASSSGGGPGGSGGGGSGGPGAGTSFPPPGVKLGRDSGKVTTVVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVRCTCTSSSATVRRARRTSCASKLYIYKTNSG

SEQ ID NO: 852755 - protein, 50 aa, Homo sapiens
MSPAPIPQVFKSRTPPEAIALCSSLLEYTPSSRLSPLEACAHSFFDELRC

SEQ ID NO: 852756 - protein, 224 aa, Homo sapiens
MSSGKSARYNRFSGGPSNLPTPDVTTGTRMETTFGPAFSAVTTITKADGTSTYKQHCRTPSSSSTLAYSPRDEEDSMPPISTPRRSDSAISVRSLHSESSMSLRSTFSLPEEEEEPEPLVFAEQPSVKLCCQLCCSVFKDPVITTCGTRRGGDGLNQTTCPVAKQTTGGDKSRAEHWAHEHAAGRKKGRPTRGAEAPTHNGDKDDKPRQNNRKKDAGATQDDKT

SEQ ID NO: 852757 - protein, 122 aa, Homo sapiens
MSLRSTFSLPEEEEEPEPLVFAEQPSVKLCCQLCCSVFKDPVITTCGHTFCRRCALKSEKCPVDNVKLTVVVNNIAVAEQIGELFIHCRHGCRVAGSGKPPIFEVDPRGCPFTIKLSARKDH

SEQ ID NO: 852758 - protein, 670 aa, Homo sapiens
MSSGKSARYNRFSGGPSNLPTPDVTTGTRMETTFGPAFSAVTTITKADGTSTYKQHCRTPSSSSTLAYSPRDEEDSMPPISTPRRSDSAISVRSLHSESSMSLRSTFSLPEEEEEPEPLVFAEQPSVKLCCQLCCSVFKDPVITTCGHTFCRRCALKSEKCPVDNVKLTVVVNNIAVAEQIGELFIHCRHGCRVAGSGKPPIFEVDPRGCPFTIKLSARKDHEGSCDYRPVRCPNNPSCPPLLRMNLEAHLKECEHIKCPHSKYGCTFIGNQDTYETHLETCRFEGLKEFLQQTDDRFHEMHVALAQKDQEIAFLRSMLGKLSEKIDQLEKSLELKFDVLDENQSKLSEDLMEFRRDASMLNDELSHINARLNMGILGSYDPQQIFKCKGTFVGHQGPVWCLCVYSMGDLLFSGSSDKTIKVWDTCTTYKCQKTLEGHDGIVLALCIQGCKLYSGSADCTIIVWDIQNLQKVNTIRAHDNPVCTLVSSHNVLFSGSLKAIKVWDIVGTELKLKKELTGLNHWVRALVAAQSYLYSGSYQTIKIWDIRTLDCIHVLQTSGGSVYSIAVTNHHIVCGTYENLIHVWDIESKEQVRTLTGHVGTVYALAVISTPDQTKVFSASYDRSLRVWSMDNMICTQTLLRHQGSVTALAVSRGRLFSGAVDSTVKVWTC

SEQ ID NO: 852759 - protein, 641 aa, Homo sapiens
METTFGPAFSAVTTITKADGTSTYKQHCRTPSSSSTLAYSPRDEEDSMPPISTPRRSDSAISVRSLHSESSMSLRSTFSLPEEEEEPEPLVFAEQPSVKLCCQLCCSVFKDPVITTCGHTFCRRCALKSEKCPVDNVKLTVVVNNIAVAEQIGELFIHCRHGCRVAGSGKPPIFEVDPRGCPFTIKLSARKDHEGSCDYRPVRCPNNPSCPPLLRMNLEAHLKECEHIKCPHSKYGCTFIGNQDTYETHLETCRFEGLKEFLQQTDDRFHEMHVALAQKDQEIAFLRSMLGKLSEKIDQLEKSLELKFDVLDENQSKLSEDLMEFRRDASMLNDELSHINARLNMGILGSYDPQQIFKCKGTFVGHQGPVWCLCVYSMGDLLFSGSSDKTIKVWDTCTTYKCQKTLEGHDGIVLALCIQGCKLYSGSADCTIIVWDIQNLQKVNTIRAHDNPVCTLVSSHNVLFSGSLKAIKVWDIVGTELKLKKELTGLNHWVRALVAAQSYLYSGSYQTIKIWDIRTLDCIHVLQTSGGSVYSIAVTNHHIVCGTYENLIHVWDIESKEQVRTLTGHVGTVYALAVISTPDQTKVFSASYDRSLRVWSMDNMICTQTLLRHQGSVTALAVSRGRLFSGAVDSTVKVWTC

SEQ ID NO: 852760 - protein, 670 aa, Homo sapiens; identical to SEQ ID NO: 852758

SEQ ID NO: 852761 - protein, 362 aa, Homo sapiens
QRTQKTTARYEVWVVKKIDQLEKSLELKFDVLDENQSKLSEDLMEFRRDASMLNDELSHINARLNMGILGSYDPQQIFKCKGTFVGHQGPVWCLCVYSMGDLLFSGSSDKTIKVWDTCTTYKCQKTLEGHDGIVLALCIQGCKLYSGSADCTIIVWDIQNLQKVNTIRAHDNPVCTLVSSHNVLFSGSLKAIKVWDIVGTELKLKKELTGLNHWVRALVAAQSYLYSGSYQTIKIWDIRTLDCIHVLQTSGGSVYSIAVTNHHIVCGTYENLIHVWDIESKEQVRTLTGHVGTVYALAVISTPDQTKVFSASYDRSLRVWSMDNMICTQTLLRHQGSVTALAVSRGRLFSGAVDSTVKVWTC

SEQ ID NO: 852762 - protein, 608 aa, Homo sapiens
MSSGKSARYNRFSGGPSNLPTPDVTTGTRMETTFGPAFSAVTTITKADGTSTYKQHCRTPSSSSTLAYSPRDEEDSMPPISTPRRSDSAISVRSLHSESSMSLRSTFSLPEEEEEPEPLVFAEQPSVKLCCQLCCSVFKDPVITTCGHTFCRRCALKSEKCPVDNVKLTVVVNNIAVAEQIGELFIHCRHGCRVAGSGKPPIFEVDPRGCPFTIKLSARKDHEGSCDYRPVRCPNNPSCPPLLRMNLEAHLKECEHIKCPHSKYGCTFIGNQDTYETHLETCRFEGLKEFLQQTDDRFHEMHVALAQKDQEIAFLRSMLGKLSEKIDQLEKSLELKFDVLDENQSKLSEDLMEFRRDASMLNDELSHINARLNMGILGSYDPQQIFKCKGTFVGHQGPVWCLCVYSMGDLLFSGSSDKTIKVWDTCTTYKCQKTLEGHDGIVLALCIQGCKLYSGSADCTIIVWDIQNLQKVNTIRAHDNPVCTLVSSHNVLFSGSLKAIKVWDIVGTELKLKKELTGLNHWVRALVAAQSYLYSGSYQTIKIWDIRLDVTSKVVGAHHVCNPLWARTSGEGQDGTRQDGSGTETMSNAGWDNDKNGGQEETHRGGTH

SEQ ID NO: 852763 - protein, 427 aa, Homo sapiens
MSSGKSARYNRFSGGPSNLPTPDVTTGTRMETTFGPAFSAVTTITKADGTSTYKQHCRTPSSSSTLAYSPRDEEDSMPPISTPRRSDSAISVRSLHSESSMSLRSTFSLPEEEEEPEPLVFAEQPSVKLCCQLCCSVFKDPVITTCGHTFCRRCALKSEKCPVDNVKLTVVVNNIAVAEQIGELFIHCRHGCRVAGSGKPPIFEVDPRGCPFTIKLSARKDHEGSCDYRPVRCPNNPSCPPLLRMNLEAHLKECEHIKCPHSKYGCTFIGNQDTYETHLETCRFEGLKEFLQQTDDRFHEMHVALAQKDQEIAFLRSMLGKLSEKIDQLEKSLELKFDVLDENQSKLSEDLMEFRRDASMLNDELSHINARLNMGILGSYDPQQIFKCKGTFVGHQGPVWCLCVYSMGDCKPVAWPATCPASTWLPR

SEQ ID NO: 852764 - protein, 122 aa, Homo sapiens
MSSGKSARYNRFSGGPSNLPTPDVTTGTRMETTFGPAFSAVTTITKADGTSTYKQHCRTPSSSSTLAYSPRDEEDSMPPISTPRRSDSAISVRSLHSEELRREARRSPRQSTRPRAPAFHLC

SEQ ID NO: 852765 - protein, 81 aa, Homo sapiens
MSSGKSARYNRFSGGPSNLPTPDVTTGVRVCPSASPTSPGPPACPRDLVLPAELPAQSRPELGSQGSSVGGGVVCVCVCVR

SEQ ID NO: 852766 - protein, 570 aa, Homo sapiens
MSLRSTFSLPEEEEEPEPLVFAEQPSVKLCCQLCCSVFKDPVITTCGHTFCRRCALKSEKCPVDNVKLTVVVNNIAVAEQIGELFIHCRHGCRVAGSGKPPIFEVDPRGCPFTIKLSARKDHEGSCDYRPVRCPNNPSCPPLLRMNLEAHLKECEHIKCPHSKYGCTFIGNQDTYETHLETCRFEGLKEFLQQTDDRFHEMHVALAQKDQEIAFLRSMLGKLSEKIDQLEKSLELKFDVLDENQSKLSEDLMEFRRDASMLNDELSHINARLNMGILGSYDPQQIFKCKGTFVGHQGPVWCLCVYSMGDLLFSGSSDKTIKVWDTCTTYKCQKTLEGHDGIVLALCIQGCKLYSGSADCTIIVWDIQNLQKVNTIRAHDNPVCTLVSSHNVLFSGSLKAIKVWDIVGTELKLKKELTGLNHWVRALVAAQSYLYSGSYQTIKIWDIRTLDCIHVLQTSGGSVYSIAVTNHHIVCGTYENLIHVWDIESKEQVRTLTGHVGTVYALAVISTPDQTKVFSASYDRSLRVWSMDNMICTQTLLRHQGSVTALAVSRGRLFSGAVDSTVKVWTC

SEQ ID NO: 852767 - protein, 151 aa, Homo sapiens
GSRPGPERRGTTRPGGRSGLALPARASSPFPGRRPRGHHEAGWRRCRSRAAAGGRCFPRTVDASLEHELRQECPLQPLLRGAQQSSHPRRHHRGLLRPPSRPEWKRPSDPPFQPSPPSQKLTGPAPTSSTAGHPPPPAPLPTPRGTRRTAW

SEQ ID NO: 852768 - protein, 641 aa, Homo sapiens; identical to SEQ ID NO: 852759

SEQ ID NO: 852769 - protein, 594 aa, Homo sapiens
MPPISTPRRSDSAISVRSLHSESSMSLRSTFSLPEEEEEPEPLVFAEQPSVKLCCQLCCSVFKDPVITTCGHTFCRRCALKSEKCPVDNVKLTVVVNNIAVAEQIGELFIHCRHGCRVAGSGKPPIFEVDPRGCPFTIKLSARKDHEGSCDYRPVRCPNNPSCPPLLRMNLEAHLKECEHIKCPHSKYGCTFIGNQDTYETHLETCRFEGLKEFLQQTDDRFHEMHVALAQKDQEIAFLRSMLGKLSEKIDQLEKSLELKFDVLDENQSKLSEDLMEFRRDASMLNDELSHINARLNMGILGSYDPQQIFKCKGTFVGHQGPVWCLCVYSMGDLLFSGSSDKTIKVWDTCTTYKCQKTLEGHDGIVLALCIQGCKLYSGSADCTIIVWDIQNLQKVNTIRAHDNPVCTLVSSHNVLFSGSLKAIKVWDIVGTELKLKKELTGLNHWVRALVAAQSYLYSGSYQTIKIWDIRTLDCIHVLQTSGGSVYSIAVTNHHIVCGTYENLIHVWDIESKEQVRTLTGHVGTVYALAVISTPDQTKVFSASYDRSLRVWSMDNMICTQTLLRHQGSVTALAVSRGRLFSGAVDSTVKVWTC

SEQ ID NO: 852770 - protein, 670 aa, Homo sapiens; identical to SEQ ID NO: 852758

SEQ ID NO: 852771 - protein, 427 aa, Homo sapiens; identical to SEQ ID NO: 852763

SEQ ID NO: 852772 - protein, 457 aa, Homo sapiens
MSSGKSARYNRFSGGPSNLPTPDVTTGTRMETTFGPAFSAVTTITKADGTSTYKQHCRTPSSSSTLAYSPRDEEDSMPPISTPRRSDSAISVRSLHSESSMSLRSTFSLPEEEEEPEPLVFAEQPSVKLCCQLCCSVFKDPVITTCGHTFCRRCALKSEKCPVDNVKLTVVVNNIAVAEQIGELFIHCRHGCRVAGSGKPPIFEVDPRGCPFTIKLSARKDHEGSCDYRPVRCPNNPSCPPLLRMNLEAHLKECEHIKCPHSKYGCTFIGNQDTYETHLETCRFEGLKEFLQQTDDRFHEMHVALAQKDQEIAFLRSMLGKLSEKIDQLEKSLELKFDVLDENQSKLSEDLMEFRRDASMLNDELSPINAAAVNMGILSSYDLSQICSAKDLCGPPARVVFLRSPRVTALRPPVQAPGALPPFSSRGPGSGPPGTTGTPLWPPAPRPAFRSPRVGKI

SEQ ID NO: 852773 - protein, 113 aa, Homo sapiens
GSRPGPERRGTTRPGGRSGLALPARASSPFPGRRPRGHHEAGWRRCRSRAAAGGRCFPRTVDASLEHELRQECPLQPLLRGAQQSSHPRRHHRDQNGNDLRTRLFSRHHHHKS

SEQ ID NO: 852774 - protein, 151 aa, Homo sapiens
SCNILRLKKAHRRQAVLRHIFHTGSIKPELHALDFLIFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEDEEEDDDDE

SEQ ID NO: 852775 - protein, 121 aa, Homo sapiens
PKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEDEEEDDDDE

SEQ ID NO: 852776 - protein, 108 aa, Homo sapiens
LQSGESEEAASGSRSHSHWYIELHRDSARASESRTGTGRLCASLEEKYEKDIAAYRAKGKPDAAKKGVVKAEKSKKKKEEEEDEEDEEDEEEEEDEEDEDEEEDDDDE

SEQ ID NO: 852777 - protein, 144 aa, Homo sapiens
SLYQPNNFKCKKYKALSSPFILPQGFILPLFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEDEEEDDDDE

SEQ ID NO: 852778 - protein, 94 aa, Homo sapiens
GYRAERVRRLRLAPALTAIEQPYEKKAAKLKEKYEKDIAAYRAKGKPDAAKKGVVKAEKSKKKKEEEEDEEDEEDEEEEEDEEDEDEEEDDDDE

SEQ ID NO: 852779 - protein, 219 aa, Homo sapiens
KLRLGTRLGVAQNKLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGEFQFITFYFLSVEI

SEQ ID NO: 852780 - protein, 162 aa, Homo sapiens
MAQYLSINDYSGHHRVRVTVILYSAERYLEEGYELMKSGFNLEELEKNNAQSIRAIKGPHLANSILFQSSGLTNGIIEEKDIHEELPKRKERKQEEREDDKDSDQETVDEEVDENSSGMFAAEETGEALSEETTAGEQSTRSFILDKIIEEDDAYDFSTDYV

SEQ ID NO: 852781 - protein, 537 aa, Homo sapiens
MTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVVLKYTVPGYRNSLEFFTVLAQRRGMHQKGGIPNVEGAAKLLWSEWTGASLAYYCHPPTSWTPPPYFNESIVVDMKSGFNLEELEKNNAQSIRAIKGPHLANSILFQSSGLTNGIIEEKDIHEELPKRKERKQEEREDDKDSDQETVDEEVDENSSGMFAAEETGEALSEETTAGEQSTRSFILDKIIEEDDAYDFSTDYV

SEQ ID NO: 852782 - protein, 550 aa, Homo sapiens [sequence omitted]

SEQ ID NO: 852783 - protein, 550 aa, Homo sapiens [sequence omitted]

SEQ ID NO: 852784 - protein, 537 aa, Homo sapiens; identical to SEQ ID NO: 852781

SEQ ID NO: 852785 - protein, 567 aa, Homo sapiens
MQVEAGGIGRGLCSFYSQYEKAKLKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVVLKYTVPGYRNSLEFFTVLAQRRGMHQKGGIPNVEGAAKLLWSEWTGASLAYYCHPPTSWTPPPYFNESIVVDMKSGFNLEELEKNNAQSIRAIKGPHLANSILFQSSGLTNGIIEEKDIHEELPKRKERKQEEREDDKDSDQETVDEEVDENSSGMFAAEETGEALSEETTAGEQSTRSFILDKIIEEDDAYDFSTDYV

SEQ ID NO: 852786 - protein, 537 aa, Homo sapiens; identical to SEQ ID NO: 852781

SEQ ID NO: 852787 - protein, 444 aa, Homo sapiens [sequence omitted]

SEQ ID NO: 852788 - protein, 550 aa, Homo sapiens [sequence omitted]

SEQ ID NO: 852789 - protein, 271 aa, Homo sapiens [sequence omitted]

SEQ ID NO: 852790 - protein, 377 aa, Homo sapiens
MCFFVELKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVKGPLLMSSLEPSSFIISILSRKILEVF

SEQ ID NO: 852791 - protein, 364 aa, Homo sapiens
MTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVKGPLLMSSLEPSSFIISILSRKILEVF

SEQ ID NO: 852792 - protein, 364 aa, Homo sapiens; identical to SEQ ID NO: 852791

SEQ ID NO: 852793 - protein, 543 aa, Homo sapiens
MCFFVELKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVVLKYTVPGYRNSLEFFTVLAQRRGMHQKGGIPNVEGAAKLLWSEWTGASLAYYCHPPTSWTPPPYFNESIVVDMKSGFNLEELEKNNAQSIRAIKGPHLANSILFQSSGLTNGIIEEKDIHEELPKRKERKQEEREDDKDSDQETVDEEVDENSSGMFAAEETGEALSEETTAGEAGKRGSNEAAWYRITFTF

SEQ ID NO: 852794 - protein, 508 aa, Homo sapiens
MCFFVELKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVVLKYTVPGYRNSLEFFTVLAQRRGMHQKGGIPNVEGAAKLLWSEWTGASLAYYCHPPTSWTPPPYFNESIVVDMKSGFNLEELEKNNAQSIRAIKGPHLANSILFQSSGLTNGIIEEKDIHEELPKRKERKQEEREDDKDSDQETVDEEVDVSVSSMS

SEQ ID NO: 852795 - protein, 400 aa, Homo sapiens
MCFFVELKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSLTNGIIEEKDIHEELPKRKERKQEEREDDKDSDQETVDEEVDENSSGMFAAEETGEALSEETTAGEQSTRSFILDKIIEEDDAYDFSTDYV

SEQ ID NO: 852796 - protein, 397 aa, Homo sapiens
MCFFVELKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVVLKYTVPGYRNSLEFFTVLAQRRGMHQKGGIPNVEGAAKLLWSEWTG

SEQ ID NO: 852797 - protein, 550 aa, Homo sapiens [sequence omitted]

SEQ ID NO: 852798 - protein, 550 aa, Homo sapiens [sequence omitted]

SEQ ID NO: 852799 - protein, 550 aa, Homo sapiens [sequence omitted]

SEQ ID NO: 852800 - protein, 543 aa, Homo sapiens; identical to SEQ ID NO: 852793

SEQ ID NO: 852801 - protein, 543 aa, Homo sapiens; identical to SEQ ID NO: 852793

SEQ ID NO: 852802 - protein, 532 aa, Homo sapiens
MCFFVELKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVVLKYTVPGYRNSLEFFTVLAQRRGMHQKGGIPNVEGAAKLLWSEWTGASLAYYCHPPTSWTPPPYFNESIVVDMKSGFNLEELEKNNAQSIRAIKGPHLANSILFQSSGLTNGIIEEKDIHEELPKRKERKQEEREDDKDSDQETVDEEVDENSSGMFAAEETILDKIIEEDDAYDFSTDYV

SEQ ID NO: 852803 - protein, 310 aa, Homo sapiens
MCFFVELKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRACKLAPLDKPVTILKWPEL

SEQ ID NO: 852804 - protein, 294 aa, Homo sapiens
MCFFVELKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGSKCGESSFHSFTDRCFVGFPGVQGRNVPGSPP

SEQ ID NO: 852805 - protein, 311 aa, Homo sapiens
MQVEAGGIGRGLCSFYSQYEKAKLKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGSKCGESSFHSFTDRCFVGFPGVQGRNVPGSPP

SEQ ID NO: 852806 - protein, 126 aa, Homo sapiens
RGSSTTAGEQSTRSFILEAIKGPHLANSILFQSSGLTNGIIEEKDIHEELPKRKERKQEEREDDKDSDQETVDEEVDENSSGMFAAEETGEALSEETTAGEQSTRSFILDKIIEEDDAYDFSTDYV

SEQ ID NO: 852807 - protein, 549 aa, Homo sapiens
MKRPKLKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVVLKYTVPGYRNSLEFFTVLAQRRGMHQKGGIPNVEGAAKLLWSEWTGASLAYYCHPPTSWTPPPYFNESIVVDMKSGFNLEELEKNNAQSIRAIKGPHLANSILFQSSGLTNGIIEEKDIHEELPKRKERKQEEREDDKDSDQETVDEEVDENSSGMFAAEETGEALSEETTAGEQSTRSFILDKIIEEDDAYDFSTDYV

SEQ ID NO: 852808 - protein, 493 aa, Homo sapiens
KLRLGTRLGVAQNKLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVVLKYTVPGYRNSLEFFTVLAQRRGMHQKGGIPNVEGAAKLLWSEWTGASLAYYCHPPTSWTPPPYFNESIVVDMKSGFNLEELEKNNAQSIRAIKGPHLANSILFQSSGLTNGIIEEKDIHEELPKRKERKQEEREDDKDSDQETVDEEVDENSSGMFAAEETGEALSEETTAGEQSTRSFILDKIIEEDDAYDFSTDYV

SEQ ID NO: 852809 - protein, 403 aa, Homo sapiens
KLRLGTRLGVAQNKVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVVLKYTVPGYRNSLEFFTVLAQRRGMHQKGGIPNVEGAAKLLWSEWTGASLAYYCHPPTSWTPPPYFNESIVVDMKSGFNLEELEKNNAQSIRAIKGPHLANSILFQSSGLTNGIIEEKDIHEELPKRKERKQEEREDDKDSDQETVDEEVDENSSGMFAAEETGEALSEETTAGEQSTRSFILDKIIEEDDAYDFSTDYV

SEQ ID NO: 852810 - protein, 397 aa, Homo sapiens; identical to SEQ ID NO: 852796

SEQ ID NO: 852811 - protein, 397 aa, Homo sapiens; identical to SEQ ID NO: 852796

SEQ ID NO: 852812 - protein, 176 aa, Homo sapiens [sequence omitted]

SEQ ID NO: 852813 - protein, 508 aa, Homo sapiens; identical to SEQ ID NO: 852794

SEQ ID NO: 852814 - protein, 550 aa, Homo sapiens [sequence omitted]

SEQ ID NO: 852815 - protein, 126 aa, Homo sapiens; identical to SEQ ID NO: 852806

SEQ ID NO: 852816 - protein, 550 aa, Homo sapiens [sequence omitted]

SEQ ID NO: 852817 - protein, 96 aa, Homo sapiens
LTFYSSLSLVSPPCHSGPPLLVLLRSFPFCGLCCPSHRSRFYSPRALFFRFGVRNLLRSVLFMSPRGFLFVVSALGAARLTAISFVGPPGPPSIVL

SEQ ID NO: 852818 - protein, 535 aa, Homo sapiens
MCFFVELKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVVLKYTVPGYRNSLEFFTVLAQRRGMHQKGGIPNVEGAAKLLWSEWTGASLAYYCHPPTSWTPPPYFNESIVVDMKSGFNLEELEKNNAQSIRAIKGPHLANSILFQSSGLTNGIIEEKDIHEELPKRKERKQEEREDDKDSDQETVDEEVDENSSGMFAAEETGEALSEETTAVYRKAGLSFGMK

SEQ ID NO: 852819 - protein, 397 aa, Homo sapiens; identical to SEQ ID NO: 852796

SEQ ID NO: 852820 - protein, 263 aa, Homo sapiens
MTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGEFQFITFYFLSVEI

SEQ ID NO: 852821 - protein, 183 aa, Homo sapiens
MCFFVELKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSGE

SEQ ID NO: 852822 - protein, 212 aa, Homo sapiens
MLPGPASGRQDRGTKISPPAKKPNCYGGRKRKRCGSDSQRGGHTQPPSAQPATGDAERPGRHENRPHLGDPGRWFASAQARAPLPRMSSAAPNPPVAVSGASYAAAAVTMAHYKAADSKREQFRRYLEKSGVLDTLTKVLVALYEEPEKPNSALDFLKHHLGAATPENPEIELLRLELAEMKEKYEAIVEENKKLKAKLAQYEPPQEEKRAE

SEQ ID NO: 852823 - protein, 114 aa, Homo sapiens
FGTSAPLAAVTMAHYKAADSKREQFRRYLEKSGVLDTLTKVLVALYEEPEKPNSALDFLKHHLGAATPENPEIELLRLELAEMKEKYEAIVEENKKLKAKLAQYEPPQEEKRAE

SEQ ID NO: 852824 - protein, 130 aa, Homo sapiens
MLPGPASGRQDRGTKISPPAKKPNCYGGRKRKRCGSDSQRGGHTQPPSAQPATGDAERPGRHENRPHLGDPGRWFASAQARAPLPRMSSAAPNPPVAVSGASYAAAAVTMAHYKAADSKREQFRSVGSLI

SEQ ID NO: 852825 - protein, 147 aa, Homo sapiens
RRGWGHAGGSKPLVGSGWEWGRARRFGREGPEVVRRRRGCRTPSAFFLLGSRALATDPRCLFRPPTRSVSSSGVLVALYEEPEKPNSALDFLKHHLGAATPENPEIELLRLELAEMKEKYEAIVEENKKLKAKLAQYEPPQEEKRAE

SEQ ID NO: 852826 - protein, 212 aa, Homo sapiens; identical to SEQ ID NO: 852822

SEQ ID NO: 852827 - protein, 84 aa, Homo sapiens
RRGWGHAGGSKPLVGSGWEWGRARRFGREGPEVVRRRRGCRTPSAFFLLGSRALATDPRCLFRPPTRSVSSSGGTWRSRGCWTR

SEQ ID NO: 852828 - protein, 140 aa, Homo sapiens
MLPGPASGRQDRGTKISPPAKKPNCYGGRKRKRCGSDSQRGGHTQPPSAQPATGDAERPGRHENRPHLGDPGRWFASAQARAPLPRMSSAAPNPPVAVSGASYAAAAVTMAHYKAADSKREQFRRYLEKSGVLDTLTKVF

SEQ ID NO: 852829 - protein, 212 aa, Homo sapiens; identical to SEQ ID NO: 852822

SEQ ID NO: 852830 - protein, 140 aa, Homo sapiens; identical to SEQ ID NO: 852828

SEQ ID NO: 852831 - protein, 108 aa, Homo sapiens
CESLTSLMACFPHKKTTWTQMKTSPFLQFPLTQQDSQHFQVKSPLRLAENWNFFCYFLQSYIDVSGQVIKNNSYYGLRCASHCLRALCMLTLEMGAVFQVRELKLGGN

SEQ ID NO: 852832 - protein, 222 aa, Homo sapiens
LFSPANGSGLPSPRGGKAATEARGSGKARGFGPSSHISGSRPNRQTMGAPATRRCVEWLLGLYFLSHIPITLFMDLQAVLPRELYPVEFRNLLKWYAKEFKDPLLQEPPAWFKSFLFCELVFQLPFFPIATYAFLKGSCKWIRTPAIIYSVHTMTTLIPILSTFLFEDFSKASGFKGQRPETLHERLTLVSVYAPYLLIPFILLIFMLRSPYYKYEEKRKKK

SEQ ID NO: 852833 - protein, 167 aa, Homo sapiens
SGFQLPLSGPAHASPAPNPTLVRCFPRALSLSQPLLPSGGGERFVSFKVTSSLGLRFPAIPPLAGCQCLREVVWMKWCPKSHVRFALSFWFFVCLFGRALKYQSDPKEKIRVEIDLSEGLAPWLVQLGRSQIVTASRSGSSNFQSSGVNCHLFRLALQYWVRVTMIS

SEQ ID NO: 852834 - protein, 77 aa, Homo sapiens
GRARWLTPVIPALWEAEAGGSRGLERLGSSDLPTSVSLSAGITDVNHWAQPKPSPSKGTGMNRPIGLRVGKGVWARL

SEQ ID NO: 852835 - protein, 222 aa, Homo sapiens; identical to SEQ ID NO: 852832

SEQ ID NO: 852836 - protein, 62 aa, Homo sapiens
YMYRACMYPLHVPLHDGQRAQIHALEGGEVKIFSRNQEDNTGKYPDIISRIPKIKLPPVTCK

SEQ ID NO: 852837 - protein, 919 aa, Homo sapiens
MQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDEDREAKRKKEEEEEETPKESLTEAEVATEKEGEDGDQPTTPPKPLKTSKAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRQLESVRAEAAEKGDVGLVAENSRSTQRLMLPPPPLTASGVFSKFRDIARLTGSASTAKKIDIIKGLFVACRHSEARFIARSLSGRLRLGLAEQSVLAALSQAVSLTPPGQEFPPAMVDAGKGKTAEARKTWLEEQGMILKQTFCEVPDLDRIIPVLLEHGLERLPEHCKLSPGIPLKPMLAHPTRGISEVLKRFEEAAFTCEYKYDGQRAQIHALEGGEVKIFSRNQEDNTGKYPDIISRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKLGTGFSDEELEEHHQSLKALVLPSPRPYVRIDGAVIPDHWLDPSAVWEVKCADLSLSPIYPAARGLVDSDKGISLRFPRFIRVREDKQPEQATTSAQVACLYRKQSQIQNQQGEDSGSDPEDTY

SEQ ID NO: 852838 - protein, 919 aa, Homo sapiens; identical to SEQ ID NO: 852837

SEQ ID NO: 852839 - protein, 377 aa, Homo sapiens [sequence omitted]

SEQ ID NO: 852840 - protein, 331 aa, Homo sapiens
EDLESWCCFFTRTYQRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKLGTGFSDEELEEHHQSLKALVLPSPRPYVRIDGAVIPDHWLDPSAVWEVKCADLSLSPIYPAARGLVDSDKGISLRFPRFIRVREDKQPEQATTSAQVACLYRKQSQIQNQQGEDSGSDPEDTY

SEQ ID NO: 852841 - protein, 263 aa, Homo sapiens
MSQSLFSLPALQSLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKLGTGFSDEELEEHHQSLKALVLPSPRPYVRIDGAVIPDHWLDPSAVWEVKCADLSLSPIYPAARGLVDSDKGISLRFPRFIRVREDKQPEQATTSAQVACLYRKQSQIQNQQGEDSGSDPEDTY

SEQ ID NO: 852842 - protein, 358 aa, Homo sapiens
MQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDEDREAKRKKEEEEEETPKESLTEAEVATEKEGEDGDQPTTPPKPLKTSKAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGAWVQGMSWTDPRVIIAFAF

SEQ ID NO: 852843 - protein, 274 aa, Homo sapiens
MQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDEDREAKRKKEEEEEETPKESLTEAEVATEKEGEDGDQPTTPPKPLKTSSTDPTTASELEVDQEAESRTMTETDKLAQKSQQASTSHHRTQVKKLKKRTGQQAGHRDPSYRFAGVSILDVTALVHNAKILTC

SEQ ID NO: 852844 - protein, 919 aa, Homo sapiens; identical to SEQ ID NO: 852837

SEQ ID NO: 852845 - protein, 357 aa, Homo sapiens
MKPMTKEEWDARQSIIRKEQLTDEEKCWTGRENSDANMQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDEDREAKRKKEEEEEETPKESLTEAEVATEKEGEDGDQPTTPPKPLKTSSTDPTTASELEVDQEAGGRTMTETDKLAQKSQQASTSHHRTQVKKLKKRTGQQAGHRDPSYRFAGVSILEDSPGAQRKDPNVLDELKYTSLYRGEIHNHSRFHYTQTQEHTQRWFYQSHRQFIKQETLS

SEQ ID NO: 852846 - protein, 956 aa, Homo sapiens
MKPMTKEEWDARQSIIRKEQLTDEEKCWTGRENSDANMQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDEDREAKRKKEEEEEETPKESLTEAEVATEKEGEDGDQPTTPPKPLKTSKAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRQLESVRAEAAEKGDVGLVAENSRSTQRLMLPPPPLTASGVFSKFRDIARLTGSASTAKKIDIIKGLFVACRHSEARFIARSLSGRLRLGLAEQSVLAALSQAVSLTPPGQEFPPAMVDAGKGKTAEARKTWLEEQGMILKQTFCEVPDLDRIIPVLLEHGLERLPEHCKLSPGIPLKPMLAHPTRGISEVLKRFEEAAFTCEYKYDGQRAQIHALEGGEVKIFSRNQEDNTGKYPDIISRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKLGTGFSDEELEEHHQSLKALVLPSPRPYVRIDGAVIPDHWLDPSAVWEVKCADLSLSPIYPAARGLVDSDKGISLRFPRFIRVREDKQPEQATTSAQVACLYRKQSQIQNQQGEDSGSDPEDTY

SEQ ID NO: 852847 - protein, 889 aa, Homo sapiens
MQRSIMAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDEDREAKRKKEEEEEETPKESLTEAEVATEKEGEDGDQPTTPPKPLKTSKAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRQLESVRAEAAEKGDVGLVAENSRSTQRLMLPPPPLTASGVFSKFRDIARLTGSASTAKKIDIIKGLFVACRHSEARFIARSLSGRLRLGLAEQSVLAALSQAVSLTPPGQEFPPAMVDAGKGKTAEARKTWLEEQGMILKQTFCEVPDLDRIIPVLLEHGLERLPEHCKLSPGIPLKPMLAHPTRGISEVLKRFEEAAFTCEYKYDGQRAQIHALEGGEVKIFSRNQEDNTGKYPDIISRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKLGTGFSDEELEEHHQSLKALVLPSPRPYVRIDGAVIPDHWLDPSAVWEVKCADLSLSPIYPAARGLVDSDKGISLRFPRFIRVREDKQPEQATTSAQVACLYRKQSQIQNQQGEDSGSDPEDTY

SEQ ID NO: 852848 - protein, 801 aa, Homo sapiens
MQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDEDREAKRKKEEEEEETPKESLTEAEVATEKEGEDGDQPTTPPKPLKTSKAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRQLESVRAEAAEKGDVGLVAENSRSTQRLMLPPPPLTASGVFSKFRDIARLTGSASTAKKIDIIKGLFVACRHSEARFIARSLSGRLRLGLAEQSVLAALSQAVSLTPPGQEFPPAMVDAGKGKTAEARKTWLEEQGMILKQTFCEVPDLDRIIPVLLEHGLERLPEHCKLSPGIPLKPMLAHPTRGISEVLKRFEEAAFTCEYKYDGQRAQIHALEGGEVKIFSRNQEDNTGKYPDIISRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKVLGNWG

SEQ ID NO: 852849 - protein, 230 aa, Homo sapiens
TVSLSPSSRSLALSLPLLSLMSCLSPQGLSFLSISHSSQLPPFSTFYFKGVLFLFPSFTFCFSFYFCLLQGGVLFLFPYFTSYFCLLQGGACFFPFLPLPSPPTLGLDFEIPDPLFLSSSAQLQALVLPSPRPYVRIDGAVIPDHWLDPSAVWEVKCADLSLSPIYPAARGLVDSDKGISLRFPRFIRVREDKQPEQATTSAQVACLYRKQSQIQNQQGEDSGSDPEDTY

SEQ ID NO: 852850 - protein, 85 aa, Homo sapiens
YGLDFVAKLLWQPVNFKSQGRGVLCEGVDSDKGISLRFPRFIRVREDKQPEQATTSAQVACLYRKQSQIQNQQGEDSGSDPEDTY

SEQ ID NO: 852851 - protein, 108 aa, Homo sapiens
EGLKGAACTGAVTVCRQRRGEGPEPSRGYISGCELSGMGAHEPARSDTPSPLPPQLGSSSRNGPFRKSWKSRVRTRTEKPRGRRRRKVSPQKERSVCVCVCVCVKPRG

SEQ ID NO: 852852 - protein, 152 aa, Homo sapiens
MGLSYSHEPHTDWAKYFKGKKIHGEIDIKVEQAEFSDLNLVAHANGGFSVDMEVLRNGVKVVRSLKPDFVLIRQHAFSMARNGDYRSLVIGLQYAGIPSVNSLHSVYNFCDKPWVFAQMVRLHKKLGTEEFPLIDQTFYPNHKEMVSLGKIE

SEQ ID NO: 852853 - protein, 705 aa, Homo sapiens
MNYLRRRLSDSNFMANLPNGYMTDLQRPQPPPPPPGAHSPGATPGPGTATAERSSGVAPAASPAAPSPGSSGGGGFFSSLSNAVKQTTAAAAATFSEQVGGGSGGAGRGGAASRVLLVIDEPHTDWAKYFKGKKIHGEIDIKVEQAEFSDLNLVAHANGGFSVDMEVLRNGVKVVRSLKPDFVLIRQHAFSMARNGDYRSLVIGLQYAGIPSVNSLHSVYNFCDKPWVFAQMVRLHKKLGTEEFPLIDQTFYPNHKEMLSSTTYPVVVKMGHAHSGMGKVKVDNQHDFQDIASVVALTKTYATAEPFIDAKYDVRVQKIGQNYKAYMRTSVSGNWKTNTGSAMLEQIAMSDRYKLWVDTCSEIFGGLDICAVEALHGKDGRDHIIEVVGSSMPLIGDHQDEDKQLIVELVVNKMAQALPRQRQRDASPGRGSHGQTPSPGALPLGRQTSQQPAGPPAQQRPPPQGGPPQPGPGPQRQGPPLQQRPPPQGQQHLSGLGPPAGSPLPQRLPSPTSAPQQPASQAAPPTQGQGRQSRPVAGGPGAPPAARPPASPSPQRQAGPPQATRQTSVSGPAPPKASGAPPGGQQRQGPPQKPPGPAGPTRQASQAGPVPRTGPPTTQQPRPSGPGPAGRPKPQLAQKPSQDVPPPATAAAGGPPHPQLNKSQSLTNAFNLPEPAPPRPSLSQDEVKAETIRSLRKSFASLFSD

SEQ ID NO: 852854 - protein, 705 aa, Homo sapiens; identical to SEQ ID NO: 852853

SEQ ID NO: 852855 - protein, 509 aa, Homo sapiens
LRLSEPMSRNGVKVVRSLKPDFVLIRQHAFSMARNGDYRSLVIGLQYAGIPSVNSLHSVYNFCDKPWVFAQMVRLHKKLGTEEFPLIDQTFYPNHKEMLSSTTYPVVVKMGHAHSGMGKVKVDNQHDFQDIASVVALTKTYATAEPFIDAKYDVRVQKIGQNYKAYMRTSVSGNWKTNTGSAMLEQIAMSDRYKLWVDTCSEIFGGLDICAVEALHGKDGRDHIIEVVGSSMPLIGDHQDEDKQLIVELVVNKMAQALPRQRQRDASPGRGSHGQTPSPGALPLGRQTSQQPAGPPAQQRPPPQGGPPQPGPGPQRQGPPLQQRPPPQGQQHLSGLGPPAGSPLPQRLPSPTSAPQQPASQAAPPTQGQGRQSRPVAGGPGAPPAARPPASPSPQRQAGPPQATRQTSVSGPAPPKASGAPPGGQQRQGPPQKPPGPAGPTRQASQAGPVPRTGPPTTQQPRPSGPGPAGRPKPQLAQKPSQDVPPPATAAAGGPPHPQLKASPAQAQP

SEQ ID NO: 852856 - protein, 137 aa, Homo sapiens
PPGPPRHLADPPSATSCPAQSLPCQTRPPATNPSLKLLARVLVLLSSGSSHSILILFLLLHILLAHLSLPANHHPSAFSGPFQLPSQLRRPPCPTQLLCLRLTCPTACPWSKPFLCPPRHLTLRLETSLLIFPFVSN

SEQ ID NO: 852857 - protein, 705 aa, Homo sapiens; identical to SEQ ID NO: 852853

SEQ ID NO: 852858 - protein, 669 aa, Homo sapiens
MNYLRRRLSDSNFMANLPNGYMTDLQRPQPPPPPPGAHSPGATPGPGTATAERSSGVAPAASPAAPSPGSSGGGGFFSSLSNAVKQTTAAAAATFSEQVGGGSGGAGRGGAASRVLLVIDEPHTDWAKYFKGKKIHGEIDIKVEQAEFSDLNLVAHANGGFSVDMEVLRNGVKVVRSLKPDFVLIRQHAFSMARNGDYRSLVIGLQYAGIPSVNSLHSVYNFCDKPWVFAQMVRLHKKLGTEEFPLIDQTFYPNHKEMLSSTTYPVVVKMGHAHSGMGKVKVDNQHDFQDIASVVALTKTYATAEPFIDAKYDVRVQKIGQNYKAYMRTSVSGNWKTNTGSAMLEQIAMSDRYKLWVDTCSEIFGGLDICAVEALHGKDGRDHIIEVVGSSMPLIGDHQDEDKQLIVELVVNKMAQALPRQRQRDASPGRGSHGQTPSPGALPLGRQTSQQPAGPPAQQRPPPQGGPPQPGPGPQRQGPPLQQRPPPQGQQHLSGLGPPAGSPLPQRLPSPTSAPQQPASQAAPPTQGQGRQSRPVAGGPGAPPAARPPASPSPQRQAGPPQATRQTSVSGPAPPKASGAPPGGQQRQGPPQKPPGPAGPTRQASQAGPVPRTGPPTTQQPRPSGPGPAGRPKPQLAQKPSQDVPPPATAAAGGPPHPQLKASPAQAQP

SEQ ID NO: 852859 - protein, 554 aa, Homo sapiens
LDTHVIFGIDEGLGSGIRLGQCHDTCDVLEVMLVVNLDLAHANGGFSVDMEVLRNGVKVVRSLKPDFVLIRQHAFSMARNGDYRSLVIGLQYAGIPSVNSLHSVYNFCDKPWVFAQMVRLHKKLGTEEFPLIDQTFYPNHKEMLSSTTYPVVVKMGHAHSGMGKVKVDNQHDFQDIASVVALTKTYATAEPFIDAKYDVRVQKIGQNYKAYMRTSVSGNWKTNTGSAMLEQIAMSDRYKLWVDTCSEIFGGLDICAVEALHGKDGRDHIIEVVGSSMPLIGDHQDEDKQLIVELVVNKMAQALPRQRQRDASPGRGSHGQTPSPGALPLGRQTSQQPAGPPAQQRPPPQGGPPQPGPGPQRQGPPLQQRPPPQGQQHLSGLGPPAGSPLPQRLPSPTSAPQQPASQAAPPTQGQGRQSRPVAGGPGAPPAARPPASPSPQRQAGPPQATRQTSVSGPAPPKASGAPPGGQQRQGPPQKPPGPAGPTRQASQAGPVPRTGPPTTQQPRPSGPGPAGRPKPQLAQKPSQDVPPPATAAAGGPPHPQLKASPAQAQP

SEQ ID NO: 852860 - protein, 119 aa, Homo sapiens
RQPFRHGRLWRAAAMALRYPMAVGLNKGHKVTKNVSKPRHSRRRGRLTKHTKFVRDMIREVCGFAPYERRAMELLKVSKDKRALKFIKKRVGTHIRAKRKREELSNVLAAMRKAAAKKD

SEQ ID NO: 852861 - protein, 4346 aa, Homo sapiens
MPVPDGSVAAAGLGLGLPAADSPGHYQLLLSGRALADRYRRIYTAALNDRDQGGGSAGHPASRNKKILNKKKLKRKQKSKSKVKTRSKSENLENTVIIPDIKLHSNPSAFNIYCNVRHCVLEWQKKEISLAAASKNSVQSGESDSDEEEESKEPPIKLPKIIEVGLCEVFELIKETRFSHPSLCLRSLQALLNVLQGQQPEVLQSEPPEVLESLFQLLLEITVRSTGMNDSTGQSLTALSCACLFSLVASWGETGRTLQAISAILTNNGSHACQTIQVPTILNSLQRSVQAVLVGKIQIQDWFSNGIKKAALMHKWPLKEISVDEDDQCLLQNDGFFLYLLCKDGLYKIGSGYSGTVRGHIYNSTSRIRNRKEKKSWLGYAQGYLLYRDVNNHSMTAIRISPETLEQDGTVMLPDCHTEGQNILFTDGEYINQIAASRDDGFVVRIFATSTEPVLQQELQLKLARKCLHACGISLFDLEKDLHIISTGFDEESAILGAGREFALMKTANGKIYYTGKYQSLGIKQGGPSAGKWVELPITKSPKIVHFSVGHDGSHALLVAEDGSIFFTGSASKGEDGESTKSRRQSKPYKPKKIIKMEGKIVVYTACNNGSSSVISKDGELYMFGKDAIYSDSSSLVTDLKGHFVTQVAMGKAHTCVLMKNGEVWTFGVNNKGQCGRDTGAMNQGGKGFGVENMATAMDEDLEEELDEKDEKSMMCPPGMHKWKLEQCMVCTVCGDCTGYGASCVSSGRPDRVPGGICGCGSGESGCAVCGCCKACARELDGQEARQRGILDAVKEMIPLDLLLAVPVPGVNIEEHLQLRQEEKRQRVIRRHRLEEGRGPLVFAGPIFMNHREQALARLRSHPAHVKHKRDKHKDGSGERGEKDASKITTYPPGSVRFDCELRAVQVSCGFHHSVVLMENGDVYTFGYGQHGQLGHGDVNSRGCPTLVQALPGPSTQVTAGSNHTAVLLMDGQVFTFGSFSKGQLGRPILDVPYWNAKPAPMPNIGSKYGRKATWIGASGDQTFLRIDEALINSHVLATSEIFASKHIIGLVPASISEPPPFKCLLINKVDGSCKTFNDSEQEDLQGFGVCLDPVYDVIWRFRPNTRELWCYNAVVADARLPSAADMQSRCSILSPELALPTGSRALTTRSHAALHILGCLDTLAAMQDLKMGVASTEEETQAVMKVYSKEDYSVVNRFESHGGGWGYSAHSVEAIRFSADTDILLGGLGLFGGRGEYTAKIKLFELGPDGGDHETDGDLLAETDVLAYDCAAREKYAMMFDEPVLLQAGWWYVAWARVSGPSSDCGSHGQASITTDDGVVFQFKSSKKSNNGTDVNAGQIPQLLYRLPTSDGSASKGKQQTSEPVHILKRSFARTVSVECFESLLSILHWSWTTLVLGVEELRGLKGFQFTATLLDLERLRFVGTCCLRLLRVYTCEIYPVSATGKAVVEETSKLAECIGKTRTLLRKILSEGVDHCMVKLDNDPQGYLSQPLSLLEAVLQECHNTFTACFHSFYPTPALQWACLCDLLNCLDQDIQEANFKTSSSRLLAAVMSALCHTSVKLTSIFPIAYDGEVLLRSIVKQVSTENDSTLVHRFPLLVAHMEKLSQSEENISGMTSFREVLEKMLVIVVLPVRNSLRRENELFSSHLVSNTCGLLASIVSELTASALGSEVDGLNSLHSVKASANRFTKTSQGRSWNTGNGSPDAICFSVDKPGIVVVGFSVYGGGGIHEYELEVLVDDSEHAGDSTHSHRWTSLELVKGTYTTDDSPSDIAEIRLDKVVPLKENVKYAVRLRNYGSRTANGDGGMTTVQCPDGVTFTFSTCSLSSNGTNQTRGQIPQILYYRSEFDGDLQSQLLSKANEEDKNCSRALSVVSTVVRASKDLLHRALAVDADDIPELLSSSSLFSMLLPLIIAYIGPVAAAIPKVAVEVFGLVQQLLPSVAILNQKYAPPAFNPNQSTDSTTGNQPEQGLSACTTSSHYAVIESEHPYKPACVMHYKVTFPECVRWMTIEFDPQCGTAQSEDVLRLLIPVRTVQNSGYGPKLTSVHENLNSWIELKKFSGSSGWPTMVLVLPGNEALFSLETASDYVKDDKASFYGFKCFAIGYEFSPGPDEGVIQLEKELANLGGVCAAALMKKDLALPIGNELEEDLEILEEAALQVCKTHSGILGKGLALSHSPTILEALEGNLPLQIQSNEQSFLDDFIACVPGSSGGRLARWLQPDSYADPQKTSLILNKDDIRCGWPTTITVQTKDQYGDVVHVPNMKVEVKAVPVSQKKMSLQQDQAKKPQRIPGSPAVTAASSNTDMTYGGLASPKLDVSYEPMIVKEARYIAITMMKVYENYSFEELRFASPTPKRPSENMLIRVNNDGTYCANWTPGAIGLYTLHVTIDGIEIDAGLEVKVKDPPKGMIPPGTQLVKPKSEPQPNKVRKFVAKDSAGLRIRSHPSLQSEQIGIVKVNGTITFIDEIHNDDGVWLRLNDETIKKYVPNMNGYTEAWCLSFNQHLGKSLLVPVDESKTNTDDFFKDINSCCPQEATMQEQDMPFLRGGPGMYKVVKTGPSGHNIRSCPNLRGIPIGMLVLGNKVKAVGEVTNSEGTWVQLDQNSMVEFCESDEGEAWSLARDRGGNQYLRHEDEQALLDQNSQTPPPSPFSVQAFNKGASCSAQGFDYGLGNSKGDRGNISTSSKPASTSGKSELSSKHSRSLKPDGRMSRTTADQKKPRGTESLSASESLILKSDAAKLRSDSHSRSLSPNHNTLQTLKSDGRMPSSSRAESPGPGSRLSSPKPKTLPANRSSPSGASSPRSSSPHDKNLPQKSTAPVKTKLDPPRERSKSDSYTLDPDTLRKKKMPLTEPLRGRSTSPKPKSVPKDSTDSPGSENRAPSPHVVQENLHSEVVEVCTSSTLKTNSLTDSTCDDSSEFKSVDEGSNKVHFSIGKAPLKDEQEMRASPKISRKCANRHTRPKKEKSSFLFKGDGSKPLEPAKQAMSPSVAECARAVFASFLWHEGIVHDAMACSSFLKFHPELSKEHAPIRSSLNSQQPTEEKETKLKNRHSLEISSALNMFNIAPHGPDISKMGSINKNKVLSMLKEPPLHEKCEDGKTETTFEMSMHNTMKSKSPLPLTLQHLVAFWEDISLATIKAASQNMIFPSPGSCAVLKKKECEKENKKSKKEKKKKEKAEVRPRGNLFGEMAQLAVGGPEKDTICELCGESHPYPVTYHMRQAHPGCGRYAGGQGYNSIGHFCGGWAGNCGDGGIGGSTWYLVCDRCREKYLREKQAAAREKVKQSRRKPMQVKTPRALPTMEAHQVIKANALFLLSLSSAAEPSILCYHPAKPFQSQLPSVKEGISEDLPVKMPCLYLQTLARHHHENFVGYQDDNLFQDEMRYLRSTSVPAPYISVTPDASPNVFEEPESNMKSMPPSLETSPITDTDLAKRTVFQRSYSVVASEYDKQHSILPARVKAIPRRRVNSGDTEVGSSLLRHPSPELSRLISAHSSLSKGERNFQWPVLAFVIQHHDLEGLEIAMKQALRKSACRVFAMEAFNWLLCNVIQTTSLHDILWHFVASLTPAPVEPEEEEDEENKTSKENSEQEKDTRVCEHPLSDIVIAGEAAHPLPHTFHRLLQTISDLMMSLPSGSSLQQMALRCWSLKFKQSDHQFLHQSNVFHHINNILSKSDDGDSEESFSISIQSGFEAMSQELCIVMCLKDLTSIVDIKTSSRPAMIGSLTDGSTETFWESGDEDKNKTKNITINCVKGINARYVSVHVDNSRDLGNKVTSMTFLTGKAVEDLCRIKQVDLDSRHIGWVTSELPGGDNHIIKIELKGPENTLRVRQVKVLGWKDGESTKIAGQISASVAQQRNCEAETLRVFRLITSQVFGKLISGDAEPTPEQEEKALLSSPEGEEKVYNATSDADLKEHMVGIIFSRSKLTNLQKQVCAHIVQAIRMEATRVREEWEHAISSKENANSQPNDEDASSDAYCFELLSMVLALSGSNVGRQYLAQQLTLLQDLFSLLHTASPRVQRQVTSLLRRVLPEVTPSRLASIIGVKSLPPADISDIIHSTEKGDWNKLGILDMFLGCIAKALTVQLKAKGTTITGTAGTTVGKGVTTVTLPMIFNSSYLRRGESHWWMKGSTPTQISEIIIKLIKDMAAGHLSEAWSRVTKNAIAETIIALTKMEEEFRSPVRCIATTRLWLALASLCVLDQDHVDRLSSGRWMGKDGQQKQMPMCDNHDDGETAAIILCNVCGNLCTDCDRFLHLHRRTKTHQRQVFKEEEEAIKVDLHEGCGRTKLFWLMALADSKTMKAMVEFREHTGKPTTSSSEACRFCGSRSGTELSAVGSVCSDADARNTLR

SEQ ID NO: 852862 - protein, 208 aa, Homo sapiens
TLEIPLANVYPCATSLKQDADDMCMICFTEALSAAPAIQLDCSHIFHLQCCRRVLENRWLGPRITFGFISCPICKNKINHIVLKDLLDPIKELYEDVRRKALMRLEYEGLHKSEAITTPGVRFYNDPAGYAMNRYAYYVCYKCRKAYFGGEARCDAEAGRGDDYDPRELICGACSDVSRAQMCPKHGTDFLEYKCRYCCSVAVFFCFG

SEQ ID NO: 852863 - protein, 4266 aa, Homo sapiens
MPVPDGSVAAAGLGLGLPAADSPGHYQLLLSGRALADRYRRIYTAALNDRDQGGGSAGHPASRNKKILNKKKLKRKQKSKSKVKTRSKSENLENTVIIPDIKLHSNPSAFNIYCNVRHCVLEWQKKEISLAAASKNSVQSGESDSDEEEESKEPPIKLPKIIEVGLCEVFELIKETRFSHPSLCLRSLQALLNVLQGQQPEVLQSEPPEVLESLFQLLLEITVRSTGMNDSTGQSLTALSCACLFSLVASWGETGRTLQAISAILTNNGSHACQTIQRLRNAIRAHQQEYKNYVHGKPPRGYEVPTILNSLQRSVQAVLVGKIQIQDWFSNGIKKAALMHKWPLKEISVDEDDQCLLQNDGFFLYLLCKDGLYKIGSGYSGTVRGHIYNSTSRIRNRKEKKSWLGYAQGYLLYRDVNNHSMTAIRISPETLEQDGTVMLPDCHTEGQNILFTDGEYINQIAASRDDGFVVRIFATSTEPVLQQELQLKLARKCLHACGISLFDLEKDLHIISTGFDEESAILGAGREFALMKTANGKIYYTGKYQSLGIKQGGPSAGKWVELPITKSPKIVHFSVGHDGSHALLVAEDGSIFFTGSASKGEDGESTKSRRQSKPYKPKKIIKMEGKIVVYTACNNGSSSVISKDGELYMFGKDAIYSDSSSLVTDLKGHFVTQVAMGKAHTCVLMKNGEVWTFGVNNKGQCGRDTGAMNQGGKGFGVENMATAMDEDLEEELDEKDEKSMMCPPGMHKWKLEQCMVCTVCGDCTGYGASCVSSGRPDRVPGGICGCGSGESGCAVCGCCKACARELDGQEARQRGILDAVKEMIPLDLLLAVPVPGVNIEEHLQLRQEEKRQRVIRRHRLEEGRGPLVFAGPIFMNHREQALARLRSHPAHVKHKRDKHKDGSGERGEKDASKITTYPPGSVRFDCELRAVQVSCGFHHSVVLMENGDVYTFGYGQHGQLGHGDVNSRGCPTLVQALPGPSTQVTAGSNHTAVLLMDGQVFTFGSFSKGQLGRPILDVPYWNAKPAPMPNIGSKYGRKATWIGASGDQTFLRIDEALINSHVLATSEIFASKHIIGLVPASISEPPPFKCLLINKVDGSCKTFNDSEQEDLQGFGVCLDPVYDVIWRFRPNTRELWCYNAVVADARLPSAADMQSRCSILSPELALPTGSRALTTRSHAALHILGCLDTLAAMQDLKMGVASTEEETQAVMKVYSKEDYSVVNRFESHGGGWGYSAHSVEAIRFSADTDILLGGLGLFGGRGEYTAKIKLFELGPDGGDHETDGDLLAETDVLAYDCAAREKYAMMFDEPVLLQAGWWYVAWARVSGPSSDCGSHGQASITTDDGVVFQFKSSKKSNNGTDVNAGQIPQLLYRLPTSDGSASKGKQQTSEPVHILKRSFARTVSVECFESLLSILHWSWTTLVLGVEELRGLKGFQFTATLLDLERLRFVGTCCLRLLRVYTCEIYPVSATGKAVVEETSKLAECIGKTRTLLRKILSEGVDHCMVKLDNDPQGYLSQPLSLLEAVLQECHNTFTACFHSFYPTPALQWACLCDLLNCLDQDIQEANFKTSSSRLLAAVMSALCHTSVKLTSIFPIAYDGEVLLRSIVKQVSTENDSTLVHRFPLLVAHMEKLSQSEENISGMTSFREVLEKMLVIVVLPVRNSLRRENELFSSHLVSNTCGLLASIVSELTASALGSEVDGLNSLHSVKASANRFTKTSQGRSWNTGNGSPDAICFSVDKPGIVVVGFSVYGGGGIHEYELEVLVDDSEHAGDSTHSHRWTSLELVKGTYTTDDSPSDIAEIRLDKVVPLKENVKYAVRLRNYGSRTANGDGGMTTVQCPDGVTFTFSTCSLSSNGTNQTRGQIPQILYYRSEFDGDLQSQLLSKANEEDKNCSRALSVVSTVVRASKDLLHRALAVDADDIPELLSSSSLFSMLLPLIIAYIGPVAAAIPKVAVEVFGLVQQLLPSVAILNQKYAPPAFNPNQSTDSTTGNQPEQGLSACTTSSHYAVIESEHPYKPACVMHYKVTFPECVRWMTIEFDPQCGTAQSEDVLRLLIPVRTVQNSGYGPKLTSVHENLNSWIELKKFSGSSGWPTMVLVLPGNEALFSLETASDYVKDDKASFYGFKCFAIGYEFSPGPDEGVIQLEKELANLGGVCAAALMKKDLALPIGNELEEDLEILEEAALQVCKTHSGILGKGLALSHSPTILEALEGNLPLQIQSNEQSFLDDFIACVPGSSGGRLARWLQPDSYADPQKTSLILNKDDIRCGWPTTITVQTKDQYGDVVHVPNMKVEVKAVPVSQKKMSLQQDQAKKPQRIPGSPAVTAASSNTDMTYGGLASPKLDVSYEPMIVKEARYIAITMMKVYENYSFEELRFASPTPKRPSENMLIRVNNDGTYCANWTPGAIGLYTLHVTIDGIEIDAGLEVKVKDPPKGMIPPGTQLVKPKSEPQPNKVRKFVAKDSAGLRIRSHPSLQSEQIGIVKVNGTITFIDEIHNDDGVWLRLNDETIKKYVPNMNGYTEAWCLSFNQHLGKSLLVPVDNIFNASQGVRDLDVFSWTSKAFFPQESKTNTDDFFKDINSCCPQEATMQEQDMPFLRGGPGMYKVVKTGPSGHNIRSCPNLRGIPIGMLVLGNKVKAVGEVTNSEGTWVQLDQNSMVEFCESDEGEAWSLARDRGGNQYLRHEDEQALLDQNSQTPPPSPFSVQAFNKGASCSAQGFDYGLGNSKVLTVLPTAGDQLSAILNSIQSRPNLPAPSIFDQAAKPPSSLVHSPFVFGQPLSFQQPQLQSDRGNISTSSKPASTSGKSELSSKHSRSLKPDGRMSRTTADQKKPRGTESLSASESLILKSDAAKLRSDSHSRSLSPNHNTLQTLKSDGRMPSSSRAESPGPGSRLSSPKPKTLPANRSSPSGASSPRSSSPHDKNLPQKSTAPVKTKLDPPRERSKSDSYTLDPDTLRKKKMPLTEPLRGRSTSPKPKSVPKDSTDSPGSENRAPSPHVVQENLHSEVVEVCTSSTLKTNSLTDSTCDDSSEFKSVDEGSNKVHFSIGKAPLKDEQEMRASPKISRKCANRHTRPKKEKSSFLFKGDGSKPLEPAKQAMSPSVAECARAVFASFLWHEGIVHDAMACSSFLKFHPELSKEHAPIRSSLNSQQPTEEKETKLKNRHSLEISSALNMFNIAPHGPDISKMGSINKNKVLSMLKEPPLHEKCEDGKTETTFEMSMHNTMKSKSPLPLTLQHLVAFWEDISLATIKAASQNMIFPSPGSCAVLKKKECEKENKKSKKEKKKKEKAEVRPRGNLFGEMAQLAVGGPEKDTICELCGESHPYPVTYHMRQAHPGCGRYAGGQGYNSIGHFCGGWAGNCGDGGIGGSTWYLVCDRCREKYLREKQAAAREKVKQSRRKPMQVKTPRALPTMEAHQVIKANALFLLSLSSAAEPSILCYHPAKPFQSQLPSVKEGISEDLPVKMPCLYLQTLARHHHENFVGYQDDNLFQDEMRYLRSTSVPAPYISVTPDASPNVFEEPESNMKSMPPSLETSPITDTDLAKRTVFQRSYSVVASEYDKQHSILPARVKAIPRRRVNSGDTEVGSSLLRHPSPELSRLISAHSSLSKGERNFQWPVLAFVIQHHDLEGLEIAMKQALRKSACRVFAMEAFNWLLCNVIQTTSLHDILWHFVASLTPAPVEPEEEEDEENKTSKENSEQEKDTRVCEHPLSDIVIAGEAAHPLPHTFHRLLQTISDLMMSLPSGSSLQQMALRCWSLKFKQSDHQFLHQSNVFHHINNILSKSDDGDSEESFSISIQSGFEAMSQELCIVMCLKDLTSIVDIKTSSRPAMIGSLTDGSTETFWESGDEDKNKTKNITINCVKGINARYVSVHVDNSRDLGNKVTSMTFLTGKAVEDLCRIKQVDLDSRHIGWVTSELPGGDNHIIKIELKGPENTLRVRQVKVLGWKDGESTKIAGQISASVAQQRNCEAETLRVFRLITSQVFGKLISGDAEPTPEQEEKALLSSPEGEEKVYNATSDADLKEHMVGIIFSRSKLTNLQKQVCAHIVQAIRMEATRVREEWEHAISSKENANSQPNDEDASSDAYCFELLSMVLALSGSNVGRQYLAQQLTLLQDLFSLLHTASPRVQRQVTSLLRRVLPEVTPSRLASIIGVKSLPPADISDIIHSTEKGDWNKLGILDMFLGCIAKALTVQLKAKGTTITGTAGTTVGKGVTTVTLPMIFNSSYLRRGESHWWMKGSTLPRSQRSSLNLSRIWQQVICQKLGPE

SEQ ID NO: 852864 - protein, 2026 aa, Homo sapiens
MMCRNFIRNISPFFPLFFKYFSMYDKQYKFCSYVFLFQCLVAKLSVSYNFINKFHCKMDHTGDRGNISTSSKPASTSGKSELSSKHSRSLKPDGRMSRTTADQKKPRGTESLSASESLILKSDAAKLRSDSHSRSLSPNHNTLQTLKSDGRMPSSSRAESPGPGSRLSSPKPKTLPANRSSPSGASSPRSSSPHDKNLPQKSTAPVKTKLDPPRERSKSDSYTLDPDTLRKKKMPLTEPLRGRSTSPKPKSVPKDSTDSPGSENRAPSPHVVQENLHSEVVEVCTSSTLKTNSLTDSTCDDSSEFKSVDEGSNKVHFSIGKAPLKDEQEMRASPKISRKCANRHTRPKKEKSSFLFKGDGSKPLEPAKQAMSPSVAECARAVFASFLWHEGIVHDAMACSSFLKFHPELSKEHAPIRSSLNSQQPTEEKETKLKNRHSLEISSALNMFNIAPHGPDISKMGSINKNKVLSMLKEPPLHEKCEDGKTETTFEMSMHNTMKSKSPLPLTLQHLVAFWEDISLATIKAASQNMIFPSPGSCAVLKKKECEKENKKSKKEKKKKEKAEVRPRGNLFGEMAQLAVGGPEKDTICELCGESHPYPVTYHMRQAHPGCGRYAGGQGYNSIGHFCGGWAGNCGDGGIGGSTWYLVCDRCREKYLREKQAAAREKVKQSRRKPMQVKTPRALPTMEAHQVIKANALFLLSLSSAAEPSILCYHPAKPFQSQLPSVKEGISEDLPVKMPCLYLQTLARHHHENFVGYQDDNLFQDEMRYLRSTSVPAPYISVTPDASPNVFEEPESNMKSMPPSLETSPITDTDLAKRTVFQRSYSVVASEYDKQHSILPARVKAIPRRRVNSGDTEVGSSLLRHPSPELSRLISAHSSLSKGERNFQWPVLAFVIQHHDLEGLEIAMKQALRKSACRVFAMEAFNWLLCNVIQTTSLHDILWHFVASLTPAPVEPEEEEDEENKTSKENSEQEKDTRVCEHPLSDIVIAGEAAHPLPHTFHRLLQTISDLMMSLPSGSSLQQMALRCWSLKFKQSDHQFLHQSNVFHHINNILSKSDDGDSEESFSISIQSGFEAMSQELCIVMCLKDLTSIVDIKTSSRPAMIGSLTDGSTETFWESGDEDKNKTKNITINCVKGINARYVSVHVDNSRDLGNKVTSMTFLTGKAVEDLCRIKQVDLDSRHIGWVTSELPGGDNHIIKIELKGPENTLRVRQVKVLGWKDGESTKIAGQISASVAQQRNCEAETLRVFRLITSQVFGKLISGDAEPTPEQEEKALLSSPEGEEKVYNATSDADLKEHMVGIIFSRSKLTNLQKQVCAHIVQAIRMEATRVREEWEHAISSKENANSQPNDEDASSDAYCFELLSMVLALSGSNVGRQYLAQQLTLLQDLFSLLHTASPRVQRQVTSLLRRVLPEVTPSRLASIIGVKSLPPADISDIIHSTEKGDWNKLGILDMFLGCIAKALTVQLKAKGTTITGTAGTTVGKGVTTVTLPMIFNSSYLRRGESHWWMKGSTPTQISEIIIKLIKDMAAGHLSEAWSRVTKNAIAETIIALTKMEEEFRSPVRCIATTRLWLALASLCVLDQDHVDRLSSGRWMGKDGQQKQMPMCDNHDDGETAAIILCNVCGNLCTDCDRFLHLHRRTKTHQRQVFKEEEEAIKVDLHEGCGRTKLFWLMALADSKTMKAMVEFREHTGKPTTSSSEACRFCGSRSGTELSAVGSVCSDADCQEYAKIACSKTHPCGHPCGGVKNEEHCLPCLHGCDKSATSLKQDADDMCMICFTEALSAAPAIQLDCSHIFHLQCCRRVLENRWLGPRITFGFISCPICKNKINHIVLKDLLDPIKELYEDVRRKALMRLEYEGLHKSEAITTPGVRFYNDPAGYAMNRYAYYVCYKCRKAYFGGEARCDAEAGRGDDYDPRELICGACSDVSRAQMCPKHGTDFLEYKCRYCCSVAVFFCFGTTHFCNACHDDFQRMTSIPKEELPHCPAGPKGKQLEGTECPLHVVHPPTGEEFALGCGVCRNAHTF

SEQ ID NO: 852865 - protein, 2180 aa, Homo sapiens
GIPLFVLHIHNDDGVWLRLNDETIKKYVPNMNGYTEAWCLSFNQHLGKSLLVPVDESKTNTDDFFKDINSCCPQEATMQEQDMPFLRGGPGMYKVVKTGPSGHNIRSCPNLRGIPIGMLVLGNKVKAVGEVTNSEGTWVQLDQNSMVEFCESDEGEAWSLARDRGGNQYLRHEDEQALLDQNSQTPPPSPFSVQAFNKGASCSAQGFDYGLGNSKGDRGNISTSSKPASTSGKSELSSKHSRSLKPDGRMSRTTADQKKPRGTESLSASESLILKSDAAKLRSDSHSRSLSPNHNTLQTLKSDGRMPSSSRAESPGPGSRLSSPKPKTLPANRSSPSGASSPRSSSPHDKNLPQKSTAPVKTKLDPPRERSKSDSYTLDPDTLRKKKMPLTEPLRGRSTSPKPKSVPKDSTDSPGSENRAPSPHVVQENLHSEVVEVCTSSTLKTNSLTDSTCDDSSEFKSVDEGSNKVHFSIGKAPLKDEQEMRASPKISRKCANRHTRPKKEKSSFLFKGDGSKPLEPAKQAMSPSVAECARAVFASFLWHEGIVHDAMACSSFLKFHPELSKEHAPIRSSLNSQQPTEEKETKLKNRHSLEISSALNMFNIAPHGPDISKMGSINKNKVLSMLKEPPLHEKCEDGKTETTFEMSMHNTMKSKSPLPLTLQHLVAFWEDISLATIKAASQNMIFPSPGSCAVLKKKECEKENKKSKKEKKKKEKAEVRPRGNLFGEMAQLAVGGPEKDTICELCGESHPYPVTYHMRQAHPGCGRYAGGQGYNSIGHFCGGWAGNCGDGGIGGSTWYLVCDRCREKYLREKQAAAREKVKQSRRKPMQVKTPRALPTMEAHQVIKANALFLLSLSSAAEPSILCYHPAKPFQSQLPSVKEGISEDLPVKMPCLYLQTLARHHHENFVGYQDDNLFQDEMRYLRSTSVPAPYISVTPDASPNVFEEPESNMKSMPPSLETSPITDTDLAKRTVFQRSYSVVASEYDKQHSILPARVKAIPRRRVNSGDTEVGSSLLRHPSPELSRLISAHSSLSKGERNFQWPVLAFVIQHHDLEGLEIAMKQALRKSACRVFAMEAFNWLLCNVIQTTSLHDILWHFVASLTPAPVEPEEEEDEENKTSKENSEQEKDTRVCEHPLSDIVIAGEAAHPLPHTFHRLLQTISDLMMSLPSGSSLQQMALRCWSLKFKQSDHQFLHQSNVFHHINNILSKSDDGDSEESFSISIQSGFEAMSQELCIVMCLKDLTSIVDIKTSSRPAMIGSLTDGSTETFWESGDEDKNKTKNITINCVKGINARYVSVHVDNSRDLGNKVTSMTFLTGKAVEDLCRIKQVDLDSRHIGWVTSELPGGDNHIIKIELKGPENTLRVRQVKVLGWKDGESTKIAGQISASVAQQRNCEAETLRVFRLITSQVFGKLISGDAEPTPEQEEKALLSSPEGEEKVYNATSDADLKEHMVGIIFSRSKLTNLQKQVCAHIVQAIRMEATRVREEWEHAISSKENANSQPNDEDASSDAYCFELLSMVLALSGSNVGRQYLAQQLTLLQDLFSLLHTASPRVQRQVTSLLRRVLPEVTPSRLASIIGVKSLPPADISDIIHSTEKGDWNKLGILDMFLGCIAKALTVQLKAKGTTITGTAGTTVGKGVTTVTLPMIFNSSYLRRGESHWWMKGSTPTQISEIIIKLIKDMAAGHLSEAWSRVTKNAIAETIIALTKMEEEFRSPVRCIATTRLWLALASLCVLDQDHVDRLSSGRWMGKDGQQKQMPMCDNHDDGETAAIILCNVCGNLCTDCDRFLHLHRRTKTHQRQVFKEEEEAIKVDLHEGCGRTKLFWLMALADSKTMKAMVEFREHTGKPTTSSSEACRFCGSRSGTELSAVGSVCSDADCQEYAKIACSKTHPCGHPCGGVKNEEHCLPCLHGCDKSATSLKQDADDMCMICFTEALSAAPAIQLDCSHIFHLQCCRRVLENRWLGPRITFGFISCPICKNKINHIVLKDLLDPIKELYEDVRRKALMRLEYEGLHKSEAITTPGVRFYNDPAGYAMNRYAYYVCYKCRKAYFGGEARCDAEAGRGDDYDPRELICGACSDVSRAQMCPKHGTDFLEYKCRYCCSVAVFFCFGTTHFCNACHDDFQRMTSIPKEELPHCPAGPKGKQLEGTECPLHVVHPPTGEEFALGCGVCRNAHTF

SEQ ID NO: 852866 - protein, 2197 aa, Homo sapiens
MQQPPFQSEQIGIVKVNGTITFIDEIHNDDGVWLRLNDETIKKYVPNMNGYTEAWCLSFNQHLGKSLLVPVDESKTNTDDFFKDINSCCPQEATMQEQDMPFLRGGPGMYKVVKTGPSGHNIRSCPNLRGIPIGMLVLGNKVKAVGEVTNSEGTWVQLDQNSMVEFCESDEGEAWSLARDRGGNQYLRHEDEQALLDQNSQTPPPSPFSVQAFNKGASCSAQGFDYGLGNSKGDRGNISTSSKPASTSGKSELSSKHSRSLKPDGRMSRTTADQKKPRGTESLSASESLILKSDAAKLRSDSHSRSLSPNHNTLQTLKSDGRMPSSSRAESPGPGSRLSSPKPKTLPANRSSPSGASSPRSSSPHDKNLPQKSTAPVKTKLDPPRERSKSDSYTLDPDTLRKKKMPLTEPLRGRSTSPKPKSVPKDSTDSPGSENRAPSPHVVQENLHSEVVEVCTSSTLKTNSLTDSTCDDSSEFKSVDEGSNKVHFSIGKAPLKDEQEMRASPKISRKCANRHTRPKKEKSSFLFKGDGSKPLEPAKQAMSPSVAECARAVFASFLWHEGIVHDAMACSSFLKFHPELSKEHAPIRSSLNSQQPTEEKETKLKNRHSLEISSALNMFNIAPHGPDISKMGSINKNKVLSMLKEPPLHEKCEDGKTETTFEMSMHNTMKSKSPLPLTLQHLVAFWEDISLATIKAASQNMIFPSPGSCAVLKKKECEKENKKSKKEKKKKEKAEVRPRGNLFGEMAQLAVGGPEKDTICELCGESHPYPVTYHMRQAHPGCGRYAGGQGYNSIGHFCGGWAGNCGDGGIGGSTWYLVCDRCREKYLREKQAAAREKVKQSRRKPMQVKTPRALPTMEAHQVIKANALFLLSLSSAAEPSILCYHPAKPFQSQLPSVKEGISEDLPVKMPCLYLQTLARHHHENFVGYQDDNLFQDEMRYLRSTSVPAPYISVTPDASPNVFEEPESNMKSMPPSLETSPITDTDLAKRTVFQRSYSVVASEYDKQHSILPARVKAIPRRRVNSGDTEVGSSLLRHPSPELSRLISAHSSLSKGERNFQWPVLAFVIQHHDLEGLEIAMKQALRKSACRVFAMEAFNWLLCNVIQTTSLHDILWHFVASLTPAPVEPEEEEDEENKTSKENSEQEKDTRVCEHPLSDIVIAGEAAHPLPHTFHRLLQTISDLMMSLPSGSSLQQMALRCWSLKFKQSDHQFLHQSNVFHHINNILSKSDDGDSEESFSISIQSGFEAMSQELCIVMCLKDLTSIVDIKTSSRPAMIGSLTDGSTETFWESGDEDKNKTKNITINCVKGINARYVSVHVDNSRDLGNKVTSMTFLTGKAVEDLCRIKQVDLDSRHIGWVTSELPGGDNHIIKIELKGPENTLRVRQVKVLGWKDGESTKIAGQISASVAQQRNCEAETLRVFRLITSQVFGKLISGDAEPTPEQEEKALLSSPEGEEKVYNATSDADLKEHMVGIIFSRSKLTNLQKQVCAHIVQAIRMEATRVREEWEHAISSKENANSQPNDEDASSDAYCFELLSMVLALSGSNVGRQYLAQQLTLLQDLFSLLHTASPRVQRQVTSLLRRVLPEVTPSRLASIIGVKSLPPADISDIIHSTEKGDWNKLGILDMFLGCIAKALTVQLKAKGTTITGTAGTTVGKGVTTVTLPMIFNSSYLRRGESHWWMKGSTPTQISEIIIKLIKDMAAGHLSEAWSRVTKNAIAETIIALTKMEEEFRSPVRCIATTRLWLALASLCVLDQDHVDRLSSGRWMGKDGQQKQMPMCDNHDDGETAAIILCNVCGNLCTDCDRFLHLHRRTKTHQRQVFKEEEEAIKVDLHEGCGRTKLFWLMALADSKTMKAMVEFREHTGKPTTSSSEACRFCGSRSGTELSAVGSVCSDADCQEYAKIACSKTHPCGHPCGGVKNEEHCLPCLHGCDKSATSLKQDADDMCMICFTEALSAAPAIQLDCSHIFHLQCCRRVLENRWLGPRITFGFISCPICKNKINHIVLKDLLDPIKELYEDVRRKALMRLEYEGLHKSEAITTPGVRFYNDPAGYAMNRYAYYVCYKCRKAYFGGEARCDAEAGRGDDYDPRELICGACSDVSRAQMCPKHGTDFLEYKCRYCCSVAVFFCFGTTHFCNACHDDFQRMTSIPKEELPHCPAGPKGKQLEGTECPLHVVHPPTGEEFALGCGVCRNAHTF

SEQ ID NO: 852867 - protein, 1977 aa, Homo sapiens
VKTGFLDGVDEKAMSVLESPYRDSAKGAPLAELSSKHSRSLKPDGRMSRTTADQKKPRGTESLSASESLILKSDAAKLRSDSHSRSLSPNHNTLQTLKSDGRMPSSSRAESPGPGSRLSSPKPKTLPANRSSPSGASSPRSSSPHDKNLPQKSTAPVKTKLDPPRERSKSDSYTLDPDTLRKKKMPLTEPLRGRSTSPKPKSVPKDSTDSPGSENRAPSPHVVQENLHSEVVEVCTSSTLKTNSLTDSTCDDSSEFKSVDEGSNKVHFSIGKAPLKDEQEMRASPKISRKCANRHTRPKKEKSSFLFKGDGSKPLEPAKQAMSPSVAECARAVFASFLWHEGIVHDAMACSSFLKFHPELSKEHAPIRSSLNSQQPTEEKETKLKNRHSLEISSALNMFNIAPHGPDISKMGSINKNKVLSMLKEPPLHEKCEDGKTETTFEMSMHNTMKSKSPLPLTLQHLVAFWEDISLATIKAASQNMIFPSPGSCAVLKKKECEKENKKSKKEKKKKEKAEVRPRGNLFGEMAQLAVGGPEKDTICELCGESHPYPVTYHMRQAHPGCGRYAGGQGYNSIGHFCGGWAGNCGDGGIGGSTWYLVCDRCREKYLREKQAAAREKVKQSRRKPMQVKTPRALPTMEAHQVIKANALFLLSLSSAAEPSILCYHPAKPFQSQLPSVKEGISEDLPVKMPCLYLQTLARHHHENFVGYQDDNLFQDEMRYLRSTSVPAPYISVTPDASPNVFEEPESNMKSMPPSLETSPITDTDLAKRTVFQRSYSVVASEYDKQHSILPARVKAIPRRRVNSGDTEVGSSLLRHPSPELSRLISAHSSLSKGERNFQWPVLAFVIQHHDLEGLEIAMKQALRKSACRVFAMEAFNWLLCNVIQTTSLHDILWHFVASLTPAPVEPEEEEDEENKTSKENSEQEKDTRVCEHPLSDIVIAGEAAHPLPHTFHRLLQTISDLMMSLPSGSSLQQMALRCWSLKFKQSDHQFLHQSNVFHHINNILSKSDDGDSEESFSISIQSGFEAMSQELCIVMCLKDLTSIVDIKTSSRPAMIGSLTDGSTETFWESGDEDKNKTKNITINCVKGINARYVSVHVDNSRDLGNKVTSMTFLTGKAVEDLCRIKQVDLDSRHIGWVTSELPGGDNHIIKIELKGPENTLRVRQVKVLGWKDGESTKIAGQISASVAQQRNCEAETLRVFRLITSQVFGKLISGDAEPTPEQEEKALLSSPEGEEKVYNATSDADLKEHMVGIIFSRSKLTNLQKQVCAHIVQAIRMEATRVREEWEHAISSKENANSQPNDEDASSDAYCFELLSMVLALSGSNVGRQYLAQQLTLLQDLFSLLHTASPRVQRQVTSLLRRVLPEVTPSRLASIIGVKSLPPADISDIIHSTEKGDWNKLGILDMFLGCIAKALTVQLKAKGTTITGTAGTTVGKGVTTVTLPMIFNSSYLRRGESHWWMKGSTPTQISEIIIKLIKDMAAGHLSEAWSRVTKNAIAETIIALTKMEEEFRSPVRCIATTRLWLALASLCVLDQDHVDRLSSGRWMGKDGQQKQMPMCDNHDDGETAAIILCNVCGNLCTDCDRFLHLHRRTKTHQRQVFKEEEEAIKVDLHEGCGRTKLFWLMALADSKTMKAMVEFREHTGKPTTSSSEACRFCGSRSGTELSAVGSVCSDADCQEYAKIACSKTHPCGHPCGGVKNEEHCLPCLHGCDKSATSLKQDADDMCMICFTEALSAAPAIQLDCSHIFHLQCCRRVLENRWLGPRITFGFISCPICKNKINHIVLKDLLDPIKELYEDVRRKALMRLEYEGLHKSEAITTPGVRFYNDPAGYAMNRYAYYVCYKCRKAYFGGEARCDAEAGRGDDYDPRELICGACSDVSRAQMCPKHGTDFLEYKCRYCCSVAVFFCFGTTHFCNACHDDFQRMTSIPKEELPHCPAGPKGKQLEGTECPLHVVHPPTGEEFALGCGVCRNAHTF

SEQ ID NO: 852868 - protein, 4206 aa, Homo sapiens
MPVPDGSVAAAGLGLGLPAADSPGHYQLLLSGRALADRYRRIYTAALNDRDQGGGSAGHPASRNKKILNKKKLKRKQKSKSKVKTRSKSENLENTVIIPDIKLHSNPSAFNIYCNVRHCVLEWQKKEISLAAASKNSVQSGESDSDEEEESKEPPIKLPKIIEVGLCEVFELIKETRFSHPSLCLRSLQALLNVLQGQQPEVLQSEPPEVLESLFQLLLEITVRSTGMNDSTGQSLTALSCACLFSLVASWGETGRTLQAISAILTNNGSHACQTIQRLRNAIRAHQQEYKNYVHGKPPRGYEVPTILNSLQRSVQAVLVGKIQIQDWFSNGIKKAALMHKWPLKEISVDEDDQCLLQNDGFFLYLLCKDGLYKIGSGYSGTVRGHIYNSTSRIRNRKEKKSWLGYAQGYLLYRDVNNHSMTAIRISPETLEQDGTVMLPDCHTEGQNILFTDGEYINQIAASRDDGFVVRIFATSTEPVLQQELQLKLARKCLHACGISLFDLEKDLHIISTGFDEESAILGAGREFALMKTANGKIYYTGKYQSLGIKQGGPSAGKWVELPITKSPKIVHFSVGHDGSHALLVAEDGSIFFTGSASKGEDGESTKSRRQSKPYKPKKIIKMEGKIVVYTACNNGSSSVISKDGELYMFGKDAIYSDSSSLVTDLKGHFVTQVAMGKAHTCVLMKNGEVWTFGVNNKGQCGRDTGAMNQGGKGFGVENMATAMDEDLEEELDEKDEKSMMCPPGMHKWKLEQCMVCTVCGDCTGYGASCVSSGRPDRVPGGICGCGSGESGCAVCGCCKACARELDGQEARQRGILDAVKEMIPLDLLLAVPVPGVNIEEHLQLRQEEKRQRVIRRHRLEEGRGPLVFAGPIFMNHREQALARLRSHPAHVKHKRDKHKDGSGERGEKDASKITTYPPGSVRFDCELRAVQVSCGFHHSVVLMENGDVYTFGYGQHGQLGHGDVNSRGCPTLVQALPGPSTQVTAGSNHTAVLLMDGQVFTFGSFSKGQLGRPILDVPYWNAKPAPMPNIGSKYGRKATWIGASGDQTFLRIDEALINSHVLATSEIFASKHIIGLVPASISEPPPFKCLLINKVDGSCKTFNDSEQEDLQGFGVCLDPVYDVIWRFRPNTRELWCYNAVVADARLPSAADMQSRCSILSPELALPTGSRALTTRSHAALHILGCLDTLAAMQDLKMGVASTEEETQAVMKVYSKEDYSVVNRFESHGGGWGYSAHSVEAIRFSADTDILLGGLGLFGGRGEYTAKIKLFELGPDGGDHETDGDLLAETDVLAYDCAAREKYAMMFDEPVLLQAGWWYVAWARVSGPSSDCGSHGQASITTDDGVVFQFKSSKKSNNGTDVNAGQIPQLLYRLPTSDGSASKGKQQTSEPVHILKRSFARTVSVECFESLLSILHWSWTTLVLGVEELRGLKGFQFTATLLDLERLRFVGTCCLRLLRVYTCEIYPVSATGKAVVEETSKLAECIGKTRTLLRKILSEGVDHCMVKLDNDPQGYLSQPLSLLEAVLQECHNTFTACFHSFYPTPALQWACLCDLLNCLDQDIQEANFKTSSSRLLAAVMSALCHTSVKLTSIFPIAYDGEVLLRSIVKQVSTENDSTLVHRFPLLVAHMEKLSQSEENISGMTSFREVLEKMLVIVVLPVRNSLRRENELFSSHLVSNTCGLLASIVSELTASALGSEVDGLNSLHSVKASANRFTKTSQGRSWNTGNGSPDAICFSVDKPGIVVVGFSVYGGGGIHEYELEVLVDDSEHAGDSTHSHRWTSLELVKGTYTTDDSPSDIAEIRLDKVVPLKENVKYAVRLRNYGSRTANGDGGMTTVQCPDGVTFTFSTCSLSSNGTNQTRGQIPQILYYRSEFDGDLQSQLLSKANEEDKNCSRALSVVSTVVRASKDLLHRALAVDADDIPELLSSSSLFSMLLPLIIAYIGPVAAAIPKVAVEVFGLVQQLLPSVAILNQKYAPPAFNPNQSTDSTTGNQPEQGLSACTTSSHYAVIESEHPYKPACVMHYKVTFPECVRWMTIEFDPQCGTAQSEDVLRLLIPVRTVQNSGYGPKLTSVHENLNSWIELKKFSGSSGWPTMVLVLPGNEALFSLETASDYVKDDKASFYGFKCFAIGYEFSPGPDEGVIQLEKELANLGGVCAAALMKKDLALPIGNELEEDLEILEEAALQVCKTHSGILGKGLALSHSPTILEALEGNLPLQIQSNEQSFLDDFIACVPGSSGGRLARWLQPDSYADPQKTSLILNKDDIRCGWPTTITVQTKDQYGDVVHVPNMKVEVKAVPVSQKKMSLQQDQAKKPQRIPGSPAVTAASSNTDMTYGGLASPKLDVSYEPMIVKEARYIAITMMKVYENYSFEELRFASPTPKRPSENMLIRVNNDGTYCANWTPGAIGLYTLHVTIDGIEIDAGLEVKVKDPPKGMIPPGTQLVKPKSEPQPNKVRKFVAKDSAGLRIRSHPSLQSEQIGIVKVNGTITFIDEIHNDDGVWLRLNDETIKKYVPNMNGYTEAWCLSFNQHLGKSLLVPVDNIFNASQGVRDLDVFSWTSKAFFPQESKTNTDDFFKDINSCCPQEATMQEQDMPFLRGGPGMYKVVKTGPSGHNIRSCPNLRGIPIGMLVLGNKVKAVGEVTNSEGTWVQLDQNSMVEFCESDEGEAWSLARDRGGNQYLRHEDEQALLDQNSQTPPPSPFSVQAFNKGASCSAQGFDYGLGNSKGDRGNISTSSKPASTSGKSELSSKHSRSLKPDGRMSRTTADQKKPRGTESLSASESLILKSDAAKLRSDSHSRSLSPNHNTLQTLKSDGRMPSSSRAESPGPGSRLSSPKPKTLPANRSSPSGASSPRSSSPHDKNLPQKSTAPVKTKLDPPRERSKSDSYTLDPDTLRKKKMPLTEPLRGRSTSPKPKSVPKDSTDSPGSENRAPSPHVVQENLHSEVVEVCTSSTLKTNSLTDSTCDDSSEFKSVDEGSNKVHFSIGKAPLKDEQEMRASPKISRKCANRHTRPKKEKSSFLFKGDGSKPLEPAKQAMSPSVAECARAVFASFLWHEGIVHDAMACSSFLKFHPELSKEHAPIRSSLNSQQPTEEKETKLKNRHSLEISSALNMFNIAPHGPDISKMGSINKNKVLSMLKEPPLHEKCEDGKTETTFEMSMHNTMKSKSPLPLTLQHLVAFWEDISLATIKAASQNMIFPSPGSCAVLKKKECEKENKKSKKEKKKKEKAEVRPRGNLFGEMAQLAVGGPEKDTICELCGESHPYPVTYHMRQAHPGCGRYAGGQGYNSIGHFCGGWAGNCGDGGIGGSTWYLVCDRCREKYLREKQAAAREKVKQSRRKPMQVKTPRALPTMEAHQVIKANALFLLSLSSAAEPSILCYHPAKPFQSQLPSVKEGISEDLPVKMPCLYLQTLARHHHENFVGYQDDNLFQDEMRYLRSTSVPAPYISVTPDASPNVFEEPESNMKSMPPSLETSPITDTDLAKRTVFQRSYSVVASEYDKQHSILPARVKAIPRRRVNSGDTEVGSSLLRHPSPELSRLISAHSSLSKGERNFQWPVLAFVIQHHDLEGLEIAMKQALRKSACRVFAMEAFNWLLCNVIQTTSLHDILWHFVASLTPAPVEPEEEEDEENKTSKENSEQEKDTRVCEHPLSDIVIAGEAAHPLPHTFHRLLQTISDLMMSLPSGSSLQQMALRCWSLKFKQSDHQFLHQSNVFHHINNILSKSDDGDSEESFSISIQSGFEAMSQELCIVMCLKDLTSIVDIKTSSRPAMIGSLTDGSTETFWESGDEDKNKTKNITINCVKGINARYVSVHVDNSRDLGNKVTSMTFLTGKAVEDLCRIKQVDLDSRHIGWVTSELPGGDNHIIKIELKGPENTLRVRQVKVLGWKDGESTKIAGQISASVAQQRNCEAETLRVFRLITSQVFGKLISGDAEPTPEQEEKALLSSPEGEEKVYNATSDADLKEHMVGIIFSRSKLTNLQKQVCAHIVQAIRMEATRVREEWEHAISSKENANSQPNDEDASSDAYCFELLSMVLALSGSNVGRQYLAQQLTLLQDLFSLLHTASPRVQRQVTSLLRRVLPEVTPSRLASIIGVKSLPPADISDIIHSTEKGDWNKLGILDMFLGCIAKALTVQLKAKGTTITGTAGTTVGKGVTTVTLPMIFNSSYLRRGESHWWMKGSTLPRSQRSSLNLSRIWQQVICQKLGPE

SEQ ID NO: 852869 - protein, 470 aa, Homo sapiens [sequence omitted]

SEQ ID NO: 852870 - protein, 252 aa, Homo sapiens
MCMICFTEALSAAPAIQLDCSHIFHLQCCRRVLENRWLGPRITFGFISCPICKNKINHIVLKDLLDPIKELYEDVRRKALMRLEYEGLHKSEAITTPGVRFYNDPAGYAMNRYAYYVCYKCRKAYFGGEARCDAEAGRGDDYDPRELICGACSDVSRAQMCPKHGTDFLEYKCRYCCSVAVFFCFGTTHFCNACHDDFQRMTSIPKEELPHCPAGPKGKQLEGTECPLHVVHPPTGEEFALGCGVCRNAHTF

SEQ ID NO: 852871 - protein, 3588 aa, Homo sapiens
MPVPDGSVAAAGLGLGLPAADSPGHYQLLLSGRALADRYRRIYTAALNDRDQGGGSAGHPASRNKKILNKKKLKRKQKSKSKVKTRSKSENLENTVIIPDIKLHSNPSAFNIYCNVRHCVLEWQKKEISLAAASKNSVQSGESDSDEEEESKEPPIKLPKIIEVGLCEVFELIKETRFSHPSLCLRSLQALLNVLQGQQPEVLQSEPPEVLESLFQLLLEITVRSTGMNDSTGQSLTALSCACLFSLVASWGETGRTLQAISAILTNNGSHACQTIQRLRNAIRAHQQEYKNYVHGKPPRGYEVPTILNSLQRSVQAVLVGKIQIQDWFSNGIKKAALMHKWPLKEISVDEDDQCLLQNDGFFLYLLCKDGLYKIGSGYSGTVRGHIYNSTSRIRNRKEKKSWLGYAQGYLLYRDVNNHSMTAIRISPETLEQDGTVMLPDCHTEGQNILFTDGEYINQIAASRDDGFVVRIFATSTEPVLQQELQLKLARKCLHACGISLFDLEKDLHIISTGFDEESAILGAGREFALMKTANGKIYYTGKYQSLGIKQGGPSAGKWVELPITKSPKIVHFSVGHDGSHALLVAEDGSIFFTGSASKGEDGESTKSRRQSKPYKPKKIIKMEGKIVVYTACNNGSSSVISKDGELYMFGKDAIYSDSSSLVTDLKGHFVTQVAMGKAHTCVLMKNGEVWTFGVNNKGQCGRDTGAMNQGGKGFGVENMATAMDEDLEEELDEKDEKSMMCPPGMHKWKLEQCMVCTVCGDCTGYGASCVSSGRPDRVPGGICGCGSGESGCAVCGCCKACARELDGQEARQRGILDAVKEMIPLDLLLAVPVPGVNIEEHLQLRQEEKRQRVIRRHRLEEGRGPLVFAGPIFMNHREQALARLRSHPAHVKHKRDKHKDGSGERGEKDASKITTYPPGSVRFDCELRAVQVSCGFHHSVVLMENGDVYTFGYGQHGQLGHGDVNSRGCPTLVQALPGPSTQVTAGSNHTAVLLMDGQVFTFGSFSKGQLGRPILDVPYWNAKPAPMPNIGSKYGRKATWIGASGDQTFLRIDEALINSHVLATSEIFASKHIIGLVPASISEPPPFKCLLINKVDGSCKTFNDSEQEDLQGFGVCLDPVYDVIWRFRPNTRELWCYNAVVADARLPSAADMQSRCSILSPELALPTGSRALTTRSHAALHILGCLDTLAAMQDLKMGVASTEEETQAVMKVYSKEDYSVVNRFESHGGGWGYSAHSVEAIRFSADTDILLGGLGLFGGRGEYTAKIKLFELGPDGGDHETDGDLLAETDVLAYDCAAREKYAMMFDEPVLLQAGWWYVAWARVSGPSSDCGSHGQASITTDDGVVFQFKSSKKSNNGTDVNAGQIPQLLYRLPTSDGSASKGKQQTSEPVHILKRSFARTVSVECFESLLSILHWSWTTLVLGVEELRGLKGFQFTATLLDLERLRFVGTCCLRLLRVYTCEIYPVSATGKAVVEETSKLAECIGKTRTLLRKILSEGVDHCMVKLDNDPQGYLSQPLSLLEAVLQECHNTFTACFHSFYPTPALQWACLCDLLNCLDQDIQEANFKTSSSRLLAAVMSALCHTSVKLTSIFPIAYDGEVLLRSIVKQVSTENDSTLVHRFPLLVAHMEKLSQSEENISGMTSFREVLEKMLVIVVLPVRNSLRRENELFSSHLVSNTCGLLASIVSELTASALGSEVDGLNSLHSVKASANRFTKTSQGRSWNTGNGSPDAICFSVDKPGIVVVGFSVYGGGGIHEYELEVLVDDSEHAGDSTHSHRWTSLELVKGTYTTDDSPSDIAEIRLDKVVPLKENVKYAVRLRNYGSRTANGDGGMTTVQCPDGVTFTFSTCSLSSNGTNQTRGQIPQILYYRSEFDGDLQSQLLSKANEEDKNCSRALSVVSTVVRASKDLLHRALAVDADDIPELLSSSSLFSMLLPLIIAYIGPVAAAIPKVAVEVFGLVQQLLPSVAILNQKYAPPAFNPNQSTDSTTGNQPEQGLSACTTSSHYAVIESEHPYKPACVMHYKVTFPECVRWMTIEFDPQCGTAQSEDVLRLLIPVRTVQNSGYGPKLTSVHENLNSWIELKKFSGSSGWPTMVLVLPGNEALFSLETASDYVKDDKASFYGFKCFAIGYEFSPGPDEGVIQLEKELANLGGVCAAALMKKDLALPIGNELEEDLEILEEAALQVCKTHSGILGKGLALSHSPTILEALEGNLPLQIQSNEQSFLDDFIACVPGSSGGRLARWLQPDSYADPQKTSLILNKDDIRCGWPTTITVQTKDQYGDVVHVPNMKVEVKAVPVSQKKMSLQQDQAKKPQRIPGSPAVTAASSNTDMTYGGLASPKLDVSYEPMIVKEARYIAITMMKVYENYSFEELRFASPTPKRPSENMLIRVNNDGTYCANWTPGAIGLYTLHVTIDGIEIDAGLEVKVKDPPKGMIPPGTQLVKPKSEPQPNKVRKFVAKDSAGLRIRSHPSLQSEQIGIVKVNGTITFIDEIHNDDGVWLRLNDETIKKYVPNMNGYTEAWCLSFNQHLGKSLLVPVDNIFNASQGVRDLDVFSWTSKAFFPQESKTNTDDFFKDINSCCPQEATMQEQDMPFLRGGPGMYKVVKTGPSGHNIRSCPNLRGIPIGMLVLGNKVKAVGEVTNSEGTWVQLDQNSMVEFCESDEGEAWSLARDRGGNQYLRHEDEQALLDQNSQTPPPSPFSVQAFNKGASCSAQGFDYGLGNSKGDRGNISTSSKPASTSGKSELSSKHSRSLKPDGRMSRTTADQKKPRGTESLSASESLILKSDAAKLRSDSHSRSLSPNHNTLQTLKSDGRMPSSSRAESPGPGSRLSSPKPKTLPANRSSPSGASSPRSSSPHDKNLPQKSTAPVKTKLDPPRERSKSDSYTLDPDTLRKKKMPLTEPLRGRSTSPKPKSVPKDSTDSPGSENRAPSPHVVQENLHSEVVEVCTSSTLKTNSLTDSTCDDSSEFKSVDEGSNKVHFSIGKAPLKDEQEMRASPKISRKCANRHTRPKKEKSSFLFKGDGSKPLEPAKQAMSPSVAECARAVFASFLWHEGIVHDAMACSSFLKFHPELSKEHAPIRSSLNSQQPTEEKETKLKNRHSLEISSALNMFNIAPHGPDISKMGSINKNKVLSMLKEPPLHEKCEDGKTETTFEMSMHNTMKSKSPLPLTLQHLVAFWEDISLATIKAASQNMIFPSPGSCAVLKKKECEKENKKSKKEKKKKEKAEVRPRGNLFGEMAQLAVGGPEKDTICELCGESHPYPVTYHMRQAHPGCGRYAGGQGYNSIGHFCGGWAGNCGDGGIGGSTWYLVCDRCREKYLREKQAAAREKVKQSRRKPMQVKTPRALPTMEAHQVIKANALFLLSLSSAAEPSILCYHPAKPFQSQLPSVKEGISEDLPVKMPCLYLQTLARHHHENFVGYQDDNLFQDEMRYLRSTSVPAPYISVTPDASPNVFEEPESNMKSMPPSLETSPITDTDLAKRTVFQRSYSVVASEYDKQHSILPAQEKCLTVKKTKTKNKAKNNTTTNPKNANKHKRGGPPPQTDPPARRHTTHDSAPGLTTSTRAGPPTDGDGQSQQPPATARGNT

SEQ ID NO: 852872 - protein, 3073 aa, Homo sapiens
MPVPDGSVAAAGLGLGLPAADSPGHYQLLLSGRALADRYRRIYTAALNDRDQGGGSAGHPASRNKKILNKKKLKRKQKSKSKVKTRSKSENLENTVIIPDIKLHSNPSAFNIYCNVRHCVLEWQKKEISLAAASKNSVQSGESDSDEEEESKEPPIKLPKIIEVGLCEVFELIKETRFSHPSLCLRSLQALLNVLQGQQPEVLQSEPPEVLESLFQLLLEITVRSTGMNDSTGQSLTALSCACLFSLVASWGETGRTLQAISAILTNNGSHACQTIQRLRNAIRAHQQEYKNYVHGKPPRGYEVPTILNSLQRSVQAVLVGKIQIQDWFSNGIKKAALMHKWPLKEISVDEDDQCLLQNDGFFLYLLCKDGLYKIGSGYSGTVRGHIYNSTSRIRNRKEKKSWLGYAQGYLLYRDVNNHSMTAIRISPETLEQDGTVMLPDCHTEGQNILFTDGEYINQIAASRDDGFVVRIFATSTEPVLQQELQLKLARKCLHACGISLFDLEKDLHIISTGFDEESAILGAGREFALMKTANGKIYYTGKYQSLGIKQGGPSAGKWVELPITKSPKIVHFSVGHDGSHALLVAEDGSIFFTGSASKGEDGESTKSRRQSKPYKPKKIIKMEGKIVVYTACNNGSSSVISKDGELYMFGKDAIYSDSSSLVTDLKGHFVTQVAMGKAHTCVLMKNGEVWTFGVNNKGQCGRDTGAMNQGGKGFGVENMATAMDEDLEEELDEKDEKSMMCPPGMHKWKLEQCMVCTVCGDCTGYGASCVSSGRPDRVPGGICGCGSGESGCAVCGCCKACARELDGQEARQRGILDAVKEMIPLDLLLAVPVPGVNIEEHLQLRQEEKRQRVIRRHRLEEGRGPLVFAGPIFMNHREQALARLRSHPAHVKHKRDKHKDGSGERGEKDASKITTYPPGSVRFDCELRAVQVSCGFHHSVVLMENGDVYTFGYGQHGQLGHGDVNSRGCPTLVQALPGPSTQVTAGSNHTAVLLMDGQVFTFGSFSKGQLGRPILDVPYWNAKPAPMPNIGSKYGRKATWIGASGDQTFLRIDEALINSHVLATSEIFASKHIIGLVPASISEPPPFKCLLINKVDGSCKTFNDSEQEDLQGFGVCLDPVYDVIWRFRPNTRELWCYNAVVADARLPSAADMQSRCSILSPELALPTGSRALTTRSHAALHILGCLDTLAAMQDLKMGVASTEEETQAVMKVYSKEDYSVVNRFESHGGGWGYSAHSVEAIRFSADTDILLGGLGLFGGRGEYTAKIKLFELGPDGGDHETDGDLLAETDVLAYDCAAREKYAMMFDEPVLLQAGWWYVAWARVSGPSSDCGSHGQASITTDDGVVFQFKSSKKSNNGTDVNAGQIPQLLYRLPTSDGSASKGKQQTSEPVHILKRSFARTVSVECFESLLSILHWSWTTLVLGVEELRGLKGFQFTATLLDLERLRFVGTCCLRLLRVYTCEIYPVSATGKAVVEETSKLAECIGKTRTLLRKILSEGVDHCMVKLDNDPQGYLSQPLSLLEAVLQECHNTFTACFHSFYPTPALQWACLCDLLNCLDQDIQEANFKTSSSRLLAAVMSALCHTSVKLTSIFPIAYDGEVLLRSIVKQVSTENDSTLVHRFPLLVAHMEKLSQSEENISGMTSFREVLEKMLVIVVLPVRNSLRRENELFSSHLVSNTCGLLASIVSELTASALGSEVDGLNSLHSVKASANRFTKTSQGRSWNTGNGSPDAICFSVDKPGIVVVGFSVYGGGGIHEYELEVLVDDSEHAGDSTHSHRWTSLELVKGTYTTDDSPSDIAEIRLDKVVPLKENVKYAVRLRNYGSRTANGDGGMTTVQCPDGVTFTFSTCSLSSNGTNQTRGQIPQILYYRSEFDGDLQSQLLSKANEEDKNCSRALSVVSTVVRASKDLLHRALAVDADDIPELLSSSSLFSMLLPLIIAYIGPVAAAIPKVAVEVFGLVQQLLPSVAILNQKYAPPAFNPNQSTDSTTGNQPEQGLSACTTSSHYAVIESEHPYKPACVMHYKVTFPECVRWMTIEFDPQCGTAQSEDVLRLLIPVRTVQNSGYGPKLTSVHENLNSWIELKKFSGSSGWPTMVLVLPGNEALFSLETASDYVKDDKASFYGFKCFAIGYEFSPGPDEGVIQLEKELANLGGVCAAALMKKDLALPIGNELEEDLEILEEAALQVCKTHSGILGKGLALSHSPTILEALEGNLPLQIQSNEQSFLDDFIACVPGSSGGRLARWLQPDSYADPQKTSLILNKDDIRCGWPTTITVQTKDQYGDVVHVPNMKVEVKAVPVSQKKMSLQQDQAKKPQRIPGSPAVTAASSNTDMTYGGLASPKLDVSYEPMIVKEARYIAITMMKVYENYSFEELRFASPTPKRPSENMLIRVNNDGTYCANWTPGAIGLYTLHVTIDGIEIDAGLEVKVKDPPKGMIPPGTQLVKPKSEPQPNKVRKFVAKDSAGLRIRSHPSLQSEQIGIVKVNGTITFIDEIHNDDGVWLRLNDETIKKYVPNMNGYTEAWCLSFNQHLGKSLLVPVDNIFNASQGVRDLDVFSWTSKAFFPQESKTNTDDFFKDINSCCPQEATMQEQDMPFLRGGPGMYKVVKTGPSGHNIRSCPNLRGIPIGMLVLGNKVKAVGEVTNSEGTWVQLDQNSMVEFCESDEGEAWSLARDRGGNQYLRHEDEQALLDQNSQTPPPSPFSVQAFNKGASCSAQGFDYGLGNSKVLTVLPTAGDQLSAILNSIQSRPNLPAPSIFDQAAKPPSSLVHSPFVFGQPLSFQQPQLQSDRGNISTSSKPASTSGKSELSSKHSRSLKPDGRMSRTTADQKKPRGTESLSASESLILKSDAAKLRSDSHSRSLSPNHNTLQTLKSDGRMPSSSRAESPGPGSRLSSPKPKTLPANRSSPSGASSPRSSSPHDKNLPQKSTAPVKTKLDPPRERSKSDSYTLDPDTLRKKKMPLTEPLRGRSTSPKPKSVPKDSTDSPGSENRAPSPHVVQENLHSEVVEVCTSSTLKTNSLTDSTCDDSSEFKSVVRMYLGELLFGLNFIGVLWASGTWMLASFPRFGKFSVIIS

SEQ ID NO: 852873 - protein, 163 aa, Homo sapiens
MPVPDGSVAAAGLGLGLPAADSPGHYQLLLSGRALADRYRRIYTAALNDRDQGGGSAGHPASRNKKILNKKKLKRKQKSKSKVKTRSKSENLENTVIIPDIKLHSNPSAFNIYCNVRHCVLEWQKKEISLAAASKNSVQSGESDSDEEEESKEPPIKLPKVSH

SEQ ID NO: 852874 - protein, 227 aa, Homo sapiens
MPVPDGSVAAAGLGLGLPAADSPGHYQLLLSGRALADRYRRIYTAALNDRDQGGGSAGHPASRNKKILNKKKLKRKQKSKSKVKTRSKSENLENTVIIPDIKLHSNPSAFNIYCNVRHCVLEWQKKEISLAAASKNSVQSGESDSDEEEESKEPPIKLPKIIEVGLCEVFELIKETRFSHPSLCLRSLQALLNVLQGQQPEVLQSEPPEVLGKSQGSFSEAFKSEYN

SEQ ID NO: 852875 - protein, 4206 aa, Homo sapiens; identical to SEQ ID NO: 852868

SEQ ID NO: 852876 - protein, 4339 aa, Homo sapiens
MPVPDGSVAAAGLGLGLPAADSPGHYQLLLSGRALADRYRRIYTAALNDRDQGGGSAGHPASRNKKILNKKKLKRKQKSKSKVKTRSKSENLENTVIIPDIKLHSNPSAFNIYCNVRHCVLEWQKKEISLAAASKNSVQSGESDSDEEEESKEPPIKLPKIIEVGLCEVFELIKETRFSHPSLCLRSLQALLNVLQGQQPEVLQSEPPEVLESLFQLLLEITVRSTGMNDSTGQSLTALSCACLFSLVASWGETGRTLQAISAILTNNGSHACQTIQRLRNAIRAHQQEYKNYVHGKPPRGYEVPTILNSLQRSVQAVLVGKIQIQDWFSNGIKKAALMHKWPLKEISVDEDDQCLLQNDGFFLYLLCKDGLYKIGSGYSGTVRGHIYNSTSRIRNRKEKKSWLGYAQGYLLYRDVNNHSMTAIRISPETLEQDGTVMLPDCHTEGQNILFTDGEYINQIAASRDDGFVVRIFATSTEPVLQQELQLKLARKCLHACGISLFDLEKDLHIISTGFDEESAILGAGREFALMKTANGKIYYTGKYQSLGIKQGGPSAGKWVELPITKSPKIVHFSVGHDGSHALLVAEDGSIFFTGSASKGEDGESTKSRRQSKPYKPKKIIKMEGKIVVYTACNNGSSSVISKDGELYMFGKDAIYSDSSSLVTDLKGHFVTQVAMGKAHTCVLMKNGEVWTFGVNNKGQCGRDTGAMNQGGKGFGVENMATAMDEDLEEELDEKDEKSMMCPPGMHKWKLEQCMVCTVCGDCTGYGASCVSSGRPDRVPGGICGCGSGESGCAVCGCCKACARELDGQEARQRGILDAVKEMIPLDLLLAVPVPGVNIEEHLQLRQEEKRQRVIRRHRLEEGRGPLVFAGPIFMNHREQALARLRSHPAHVKHKRDKHKDGSGERGEKDASKITTYPPGSVRFDCELRAVQVSCGFHHSVVLMENGDVYTFGYGQHGQLGHGDVNSRGCPTLVQALPGPSTQVTAGSNHTAVLLMDGQVFTFGSFSKGQLGRPILDVPYWNAKPAPMPNIGSKYGRKATWIGASGDQTFLRIDEALINSHVLATSEIFASKHIIGLVPASISEPPPFKCLLINKVDGSCKTFNDSEQEDLQGFGVCLDPVYDVIWRFRPNTRELWCYNAVVADARLPSAADMQSRCSILSPELALPTGSRALTTRSHAALHILGCLDTLAAMQDLKMGVASTEEETQAVMKVYSKEDYSVVNRFESHGGGWGYSAHSVEAIRFSADTDILLGGLGLFGGRGEYTAKIKLFELGPDGGDHETDGDLLAETDVLAYDCAAREKYAMMFDEPVLLQAGWWYVAWARVSGPSSDCGSHGQASITTDDGVVFQFKSSKKSNNGTDVNAGQIPQLLYRLPTSDGSASKGKQQTSEPVHILKRSFARTVSVECFESLLSILHWSWTTLVLGVEELRGLKGFQFTATLLDLERLRFVGTCCLRLLRVYTCEIYPVSATGKAVVEETSKLAECIGKTRTLLRKILSEGVDHCMVKLDNDPQGYLSQPLSLLEAVLQECHNTFTACFHSFYPTPALQWACLCDLLNCLDQDIQEANFKTSSSRLLAAVMSALCHTSVKLTSIFPIAYDGEVLLRSIVKQVSTENDSTLVHRFPLLVAHMEKLSQSEENISGMTSFREVLEKMLVIVVLPVRNSLRRENELFSSHLVSNTCGLLASIVSELTASALGSEVDGLNSLHSVKASANRFTKTSQGRSWNTGNGSPDAICFSVDKPGIVVVGFSVYGGGGIHEYELEVLVDDSEHAGDSTHSHRWTSLELVKGTYTTDDSPSDIAEIRLDKVVPLKENVKYAVRLRNYGSRTANGDGGMTTVQCPDGVTFTFSTCSLSSNGTNQTRGQIPQILYYRSEFDGDLQSQLLSKANEEDKNCSRALSVVSTVVRASKDLLHRALAVDADDIPELLSSSSLFSMLLPLIIAYIGPVAAAIPKVAVEVFGLVQQLLPSVAILNQKYAPPAFNPNQSTDSTTGNQPEQGLSACTTSSHYAVIESEHPYKPACVMHYKVTFPECVRWMTIEFDPQCGTAQSEDVLRLLIPVRTVQNSGYGPKLTSVHENLNSWIELKKFSGSSGWPTMVLVLPGNEALFSLETASDYVKDDKASFYGFKCFAIGYEFSPGPDEGVIQLEKELANLGGVCAAALMKKDLALPIGNELEEDLEILEEAALQVCKTHSGILGKGLALSHSPTILEALEGNLPLQIQSNEQSFLDDFIACVPGSSGGRLARWLQPDSYADPQKTSLILNKDDIRCGWPTTITVQTKDQYGDVVHVPNMKVEVKAVPVSQKKMSLQQDQAKKPQRIPGSPAVTAASSNTDMTYGGLASPKLDVSYEPMIVKEARYIAITMMKVYENYSFEELRFASPTPKRPSENMLIRVNNDGTYCANWTPGAIGLYTLHVTIDGIEIDAGLEVKVKDPPKGMIPPGTQLVKPKSEPQPNKVRKFVAKDSAGLRIRSHPSLQSEQIGIVKVNGTITFIDEIHNDDGVWLRLNDETIKKYVPNMNGYTEAWCLSFNQHLGKSLLVPVDNIFNASQGVRDLDVFSWTSKAFFPQESKTNTDDFFKDINSCCPQEATMQEQDMPFLRGGPGMYKVVKTGPSGHNIRSCPNLRGIPIGMLVLGNKVKAVGEVTNSEGTWVQLDQNSMVEFCESDEGEAWSLARDRGGNQYLRHEDEQALLDQNSQTPPPSPFSVQAFNKGASCSAQGFDYGLGNSKGDRGNISTSSKPASTSGKSELSSKHSRSLKPDGRMSRTTADQKKPRGTESLSASESLILKSDAAKLRSDSHSRSLSPNHNTLQTLKSDGRMPSSSRAESPGPGSRLSSPKPKTLPANRSSPSGASSPRSSSPHDKNLPQKSTAPVKTKLDPPRERSKSDSYTLDPDTLRKKKMPLTEPLRGRSTSPKPKSVPKDSTDSPGSENRAPSPHVVQENLHSEVVEVCTSSTLKTNSLTDSTCDDSSEFKSVDEGSNKVHFSIGKAPLKDEQEMRASPKISRKCANRHTRPKKEKSSFLFKGDGSKPLEPAKQAMSPSVAECARAVFASFLWHEGIVHDAMACSSFLKFHPELSKEHAPIRSSLNSQQPTEEKETKLKNRHSLEISSALNMFNIAPHGPDISKMGSINKNKVLSMLKEPPLHEKCEDGKTETTFEMSMHNTMKSKSPLPLTLQHLVAFWEDISLATIKAASQNMIFPSPGSCAVLKKKECEKENKKSKKEKKKKEKAEVRPRGNLFGEMAQLAVGGPEKDTICELCGESHPYPVTYHMRQAHPGCGRYAGGQGYNSIGHFCGGWAGNCGDGGIGGSTWYLVCDRCREKYLREKQAAAREKVKQSRRKPMQVKTPRALPTMEAHQASSENFVGYQDDNLFQDEMRYLRSTSVPAPYISVTPDASPNVFEEPESNMKSMPPSLETSPITDTDLAKRTVFQRSYSVVASEYDKQHSILPARVKAIPRRRVNSGDTEVGSSLLRHPSPELSRLISAHSSLSKGERNFQWPVLAFVIQHHDLEGLEIAMKQALRKSACRVFAMEAFNWLLCNVIQTTSLHDILWHFVASLTPAPVEPEEEEDEENKTSKENSEQEKDTRVCEHPLSDIVIAGEAAHPLPHTFHRLLQTISDLMMSLPSGSSLQQMALRCWSLKFKQSDHQFLHQSNVFHHINNILSKSDDGDSEESFSISIQSGFEAMSQELCIVMCLKDLTSIVDIKTSSRPAMIGSLTDGSTETFWESGDEDKNKTKNITINCVKGINARYVSVHVDNSRDLGNKVTSMTFLTGKAVEDLCRIKQVDLDSRHIGWVTSELPGGDNHIIKIELKGPENTLRVRQVKVLGWKDGESTKIAGQISASVAQQRNCEAETLRVFRLITSQVFGKLISGDAEPTPEQEEKALLSSPEGEEKVYNATSDADLKEHMVGIIFSRSKLTNLQKQVCAHIVQAIRMEATRVREEWEHAISSKENANSQPNDEDASSDAYCFELLSMVLALSGSNVGRQYLAQQLTLLQDLFSLLHTASPRVQRQVTSLLRRVLPEVTPSRLASIIGVKSLPPADISDIIHSTEKGDWNKLGILDMFLGCIAKALTVQLKAKGTTITGTAGTTVGKGVTTVTLPMIFNSSYLRRGESHWWMKGSTPTQISEIIIKLIKDMAAGHLSEAWSRVTKNAIAETIIALTKMEEEFRSPVRCIATTRLWLALASLCVLDQDHVDRLSSGRWMGKDGQQKQMPMCDNHDDGETAAIILCNVCGNLCTDCDRFLHLHRRTKTHQRQVFKEEEEAIKVDLHEGCGRTKLFWLMALADSKTMKAMVEFREHTGKPTTSSSEACRFCGSRSGTELSAVGSVCSDADARNTLR

SEQ ID NO: 852877 - protein, 2746 aa, Homo sapiens
TSPRLGGFPADLLQACRFEKPAWTPSLCQKYAPPAFNPNQSTDSTTGNQPEQGLSACTTSSHYAVIESEHPYKPACVMHYKVTFPECVRWMTIEFDPQCGTAQSEDVLRLLIPVRTVQNSGYGPKLTSVHENLNSWIELKKFSGSSGWPTMVLVLPGNEALFSLETASDYVKDDKASFYGFKCFAIGYEFSPGPDEGVIQLEKELANLGGVCAAALMKKDLALPIGNELEEDLEILEEAALQVCKTHSGILGKGLALSHSPTILEALEGNLPLQIQSNEQSFLDDFIACVPGSSGGRLARWLQPDSYADPQKTSLILNKDDIRCGWPTTITVQTKDQYGDVVHVPNMKVEVKAVPVSQKKMSLQQDQAKKPQRIPGSPAVTAASSNTDMTYGGLASPKLDVSYEPMIVKEARYIAITMMKVYENYSFEELRFASPTPKRPSENMLIRVNNDGTYCANWTPGAIGLYTLHVTIDGIEIDAGLEVKVKDPPKGMIPPGTQLVKPKSEPQPNKVRKFVAKDSAGLRIRSHPSLQSEQIGIVKVNGTITFIDEIHNDDGVWLRLNDETIKKYVPNMNGYTEAWCLSFNQHLGKSLLVPVDNIFNASQGVRDLDVFSWTSKAFFPQESKTNTDDFFKDINSCCPQEATMQEQDMPFLRGGPGMYKVVKTGPSGHNIRSCPNLRGIPIGMLVLGNKVKAVGEVTNSEGTWVQLDQNSMVEFCESDEGEAWSLARDRGGNQYLRHEDEQALLDQNSQTPPPSPFSVQAFNKGASCSAQGFDYGLGNSKGDRGNISTSSKPASTSGKSELSSKHSRSLKPDGRMSRTTADQKKPRGTESLSASESLILKSDAAKLRSDSHSRSLSPNHNTLQTLKSDGRMPSSSRAESPGPGSRLSSPKPKTLPANRSSPSGASSPRSSSPHDKNLPQKSTAPVKTKLDPPRERSKSDSYTLDPDTLRKKKMPLTEPLRGRSTSPKPKSVPKDSTDSPGSENRAPSPHVVQENLHSEVVEVCTSSTLKTNSLTDSTCDDSSEFKSVDEGSNKVHFSIGKAPLKDEQEMRASPKISRKCANRHTRPKKEKSSFLFKGDGSKPLEPAKQAMSPSVAECARAVFASFLWHEGIVHDAMACSSFLKFHPELSKEHAPIRSSLNSQQPTEEKETKLKNRHSLEISSALNMFNIAPHGPDISKMGSINKNKVLSMLKEPPLHEKCEDGKTETTFEMSMHNTMKSKSPLPLTLQHLVAFWEDISLATIKAASQNMIFPSPGSCAVLKKKECEKENKKSKKEKKKKEKAEVRPRGNLFGEMAQLAVGGPEKDTICELCGESHPYPVTYHMRQAHPGCGRYAGGQGYNSIGHFCGGWAGNCGDGGIGGSTWYLVCDRCREKYLREKQAAAREKVKQSRRKPMQVKTPRALPTMEAHQVIKANALFLLSLSSAAEPSILCYHPAKPFQSQLPSVKEGISEDLPVKMPCLYLQTLARHHHENFVGYQDDNLFQDEMRYLRSTSVPAPYISVTPDASPNVFEEPESNMKSMPPSLETSPITDTDLAKRTVFQRSYSVVASEYDKQHSILPARVKAIPRRRVNSGDTEVGSSLLRHPSPELSRLISAHSSLSKGERNFQWPVLAFVIQHHDLEGLEIAMKQALRKSACRVFAMEAFNWLLCNVIQTTSLHDILWHFVASLTPAPVEPEEEEDEENKTSKENSEQEKDTRVCEHPLSDIVIAGEAAHPLPHTFHRLLQTISDLMMSLPSGSSLQQMALRCWSLKFKQSDHQFLHQSNVFHHINNILSKSDDGDSEESFSISIQSGFEAMSQELCIVMCLKDLTSIVDIKTSSRPAMIGSLTDGSTETFWESGDEDKNKTKNITINCVKGINARYVSVHVDNSRDLGNKVTSMTFLTGKAVEDLCRIKQVDLDSRHIGWVTSELPGGDNHIIKIELKGPENTLRVRQVKVLGWKDGESTKIAGQISASVAQQRNCEAETLRVFRLITSQVFGKLISGDAEPTPEQEEKALLSSPEGEEKVYNATSDADLKEHMVGIIFSRSKLTNLQKQVCAHIVQAIRMEATRVREEWEHAISSKENANSQPNDEDASSDAYCFELLSMVLALSGSNVGRQYLAQQLTLLQDLFSLLHTASPRVQRQVTSLLRRVLPEVTPSRLASIIGVKSLPPADISDIIHSTEKGDWNKLGILDMFLGCIAKALTVQLKAKGTTITGTAGTTVGKGVTTVTLPMIFNSSYLRRGESHWWMKGSTPTQISEIIIKLIKDMAAGHLSEAWSRVTKNAIAETIIALTKMEEEFRSPVRCIATTRLWLALASLCVLDQDHVDRLSSGRWMGKDGQQKQMPMCDNHDDGETAAIILCNVCGNLCTDCDRFLHLHRRTKTHQRQVFKEEEEAIKVDLHEGCGRTKLFWLMALADSKTMKAMVEFREHTGKPTTSSSEACRFCGSRSGTELSAVGSVCSDADCQEYAKIACSKTHPCGHPCGGVKNEEHCLPCLHGCDKSATSLKQDADDMCMICFTEALSAAPAIQLDCSHIFHLQCCRRVLENRWLGPRITFGFISCPICKNKINHIVLKDLLDPIKELYEDVRRKALMRLEYEGLHKSEAITTPGVRFYNDPAGYAMNRYAYYVCYKCRKAYFGGEARCDAEAGRGDDYDPRELICGACSDVSRAQMCPKHGTDFLEYKCRYCCSVAVFFCFGTTHFCNACHDDFQRMTSIPKEELPHCPAGPKGKQLEGTECPLHVVHPPTGEEFALGCGVCRNAHTF

SEQ ID NO: 852878 - protein, 2103 aa, Homo sapiens
MQEQDMPFLRGGPGMYKVVKTGPSGHNIRSCPNLRGIPIGMLVLGNKVKAVGEVTNSEGTWVQLDQNSMVEFCESDEGEAWSLARDRGGNQYLRHEDEQALLDQNSQTPPPSPFSVQAFNKGASCSAQGFDYGLGNSKGDRGNISTSSKPASTSGKSELSSKHSRSLKPDGRMSRTTADQKKPRGTESLSASESLILKSDAAKLRSDSHSRSLSPNHNTLQTLKSDGRMPSSSRAESPGPGSRLSSPKPKTLPANRSSPSGASSPRSSSPHDKNLPQKSTAPVKTKLDPPRERSKSDSYTLDPDTLRKKKMPLTEPLRGRSTSPKPKSVPKDSTDSPGSENRAPSPHVVQENLHSEVVEVCTSSTLKTNSLTDSTCDDSSEFKSVDEGSNKVHFSIGKAPLKDEQEMRASPKISRKCANRHTRPKKEKSSFLFKGDGSKPLEPAKQAMSPSVAECARAVFASFLWHEGIVHDAMACSSFLKFHPELSKEHAPIRSSLNSQQPTEEKETKLKNRHSLEISSALNMFNIAPHGPDISKMGSINKNKVLSMLKEPPLHEKCEDGKTETTFEMSMHNTMKSKSPLPLTLQHLVAFWEDISLATIKAASQNMIFPSPGSCAVLKKKECEKENKKSKKEKKKKEKAEVRPRGNLFGEMAQLAVGGPEKDTICELCGESHPYPVTYHMRQAHPGCGRYAGGQGYNSIGHFCGGWAGNCGDGGIGGSTWYLVCDRCREKYLREKQAAAREKVKQSRRKPMQVKTPRALPTMEAHQVIKANALFLLSLSSAAEPSILCYHPAKPFQSQLPSVKEGISEDLPVKMPCLYLQTLARHHHENFVGYQDDNLFQDEMRYLRSTSVPAPYISVTPDASPNVFEEPESNMKSMPPSLETSPITDTDLAKRTVFQRSYSVVASEYDKQHSILPARVKAIPRRRVNSGDTEVGSSLLRHPSPELSRLISAHSSLSKGERNFQWPVLAFVIQHHDLEGLEIAMKQALRKSACRVFAMEAFNWLLCNVIQTTSLHDILWHFVASLTPAPVEPEEEEDEENKTSKENSEQEKDTRVCEHPLSDIVIAGEAAHPLPHTFHRLLQTISDLMMSLPSGSSLQQMALRCWSLKFKQSDHQFLHQSNVFHHINNILSKSDDGDSEESFSISIQSGFEAMSQELCIVMCLKDLTSIVDIKTSSRPAMIGSLTDGSTETFWESGDEDKNKTKNITINCVKGINARYVSVHVDNSRDLGNKVTSMTFLTGKAVEDLCRIKQVDLDSRHIGWVTSELPGGDNHIIKIELKGPENTLRVRQVKVLGWKDGESTKIAGQISASVAQQRNCEAETLRVFRLITSQVFGKLISGDAEPTPEQEEKALLSSPEGEEKVYNATSDADLKEHMVGIIFSRSKLTNLQKQVCAHIVQAIRMEATRVREEWEHAISSKENANSQPNDEDASSDAYCFELLSMVLALSGSNVGRQYLAQQLTLLQDLFSLLHTASPRVQRQVTSLLRRVLPEVTPSRLASIIGVKSLPPADISDIIHSTEKGDWNKLGILDMFLGCIAKALTVQLKAKGTTITGTAGTTVGKGVTTVTLPMIFNSSYLRRGESHWWMKGSTPTQISEIIIKLIKDMAAGHLSEAWSRVTKNAIAETIIALTKMEEEFRSPVRCIATTRLWLALASLCVLDQDHVDRLSSGRWMGKDGQQKQMPMCDNHDDGETAAIILCNVCGNLCTDCDRFLHLHRRTKTHQRQVFKEEEEAIKVDLHEGCGRTKLFWLMALADSKTMKAMVEFREHTGKPTTSSSEACRFCGSRSGTELSAVGSVCSDADCQEYAKIACSKTHPCGHPCGGVKNEEHCLPCLHGCDKSATSLKQDADDMCMICFTEALSAAPAIQLDCSHIFHLQCCRRVLENRWLGPRITFGFISCPICKNKINHIVLKDLLDPIKELYEDVRRKALMRLEYEGLHKSEAITTPGVRFYNDPAGYAMNRYAYYVCYKCRKAYFGGEARCDAEAGRGDDYDPRELICGACSDVSRAQMCPKHGTDFLEYKCRYCCSVAVFFCFGTTHFCNACHDDFQRMTSIPKEELPHCPAGPKGKQLEGTECPLHVVHPPTGEEFALGCGVCRNAHTF

SEQ ID NO: 852879 - protein, 4206 aa, Homo sapiens; identical to SEQ ID NO: 852868

SEQ ID NO: 852880 - protein, 4206 aa, Homo sapiens; identical to SEQ ID NO: 852868

SEQ ID NO: 852881 - protein, 4206 aa, Homo sapiens; identical to SEQ ID NO: 852868

SEQ ID NO: 852882 - protein, 274 aa, Homo sapiens
TLEIPLANVYPCATSLKQDADDMCMICFTEALSAAPAIQLDCSHIFHLQCCRRVLENRWLGPRITFGFISCPICKNKINHIVLKDLLDPIKELYEDVRRKALMRLEYEGLHKSEAITTPGVRFYNDPAGYAMNRYAYYVCYKCRKAYFGGEARCDAEAGRGDDYDPRELICGACSDVSRAQMCPKHGTDFLEYKCRYCCSVAVFFCFGTTHFCNACHDDFQRMTSIPKEELPHCPAGPKGKQLEGTECPLHVVHPPTGEEFALGCGVCRNAHTF

SEQ ID NO: 852883 - protein, 2737 aa, Homo sapiens
MPVPDGSVAAAGLGLGLPAADSPGHYQLLLSGRALADRYRRIYTAALNDRDQGGGSAGHPASRNKKILNKKKLKRKQKSKSKVKTRSKSENLENTVIIPDIKLHSNPSAFNIYCNVRHCVLEWQKKEISLAAASKNSVQSGESDSDEEEESKEPPIKLPKIIEVGLCEVFELIKETRFSHPSLCLRSLQALLNVLQGQQPEVLQSEPPEVLESLFQLLLEITVRSTGMNDSTGQSLTALSCACLFSLVASWGETGRTLQAISAILTNNGSHACQTIQRLRNAIRAHQQEYKNYVHGKPPRGYEVPTILNSLQRSVQAVLVGKIQIQDWFSNGIKKAALMHKWPLKEISVDEDDQCLLQNDGFFLYLLCKDGLYKIGSGYSGTVRGHIYNSTSRIRNRKEKKSWLGYAQGYLLYRDVNNHSMTAIRISPETLEQDGTVMLPDCHTEGQNILFTDGEYINQIAASRDDGFVVRIFATSTEPVLQQELQLKLARKCLHACGISLFDLEKDLHIISTGFDEESAILGAGREFALMKTANGKIYYTGKYQSLGIKQGGPSAGKWVELPITKSPKIVHFSVGHDGSHALLVAEDGSIFFTGSASKGEDGESTKSRRQSKPYKPKKIIKMEGKIVVYTACNNGSSSVISKDGELYMFGKDAIYSDSSSLVTDLKGHFVTQVAMGKAHTCVLMKNGEVWTFGVNNKGQCGRDTGAMNQGGKGFGVENMATAMDEDLEEELDEKDEKSMMCPPGMHKWKLEQCMVCTVCGDCTGYGASCVSSGRPDRVPGGICGCGSGESGCAVCGCCKACARELDGQEARQRGILDAVKEMIPLDLLLAVPVPGVNIEEHLQLRQEEKRQRVIRRHRLEEGRGPLVFAGPIFMNHREQALARLRSHPAHVKHKRDKHKDGSGERGEKDASKITTYPPGSVRFDCELRAVQVSCGFHHSVVLMENGDVYTFGYGQHGQLGHGDVNSRGCPTLVQALPGPSTQVTAGSNHTAVLLMDGQVFTFGSFSKGQLGRPILDVPYWNAKPAPMPNIGSKYGRKATWIGASGDQTFLRIDEALINSHVLATSEIFASKHIIGLVPASISEPPPFKCLLINKVDGSCKTFNDSEQEDLQGFGVCLDPVYDVIWRFRPNTRELWCYNAVVADARLPSAADMQSRCSILSPELALPTGSRALTTRSHAALHILGCLDTLAAMQDLKMGVASTEEETQAVMKVYSKEDYSVVNRFESHGGGWGYSAHSVEAIRFSADTDILLGGLGLFGGRGEYTAKIKLFELGPDGGDHETDGDLLAETDVLAYDCAAREKYAMMFDEPVLLQAGWWYVAWARVSGPSSDCGSHGQASITTDDGVVFQFKSSKKSNNGTDVNAGQIPQLLYRLPTSDGSASKGKQQTSEPVHILKRSFARTVSVECFESLLSILHWSWTTLVLGVEELRGLKGFQFTATLLDLERLRFVGTCCLRLLRVYTCEIYPVSATGKAVVEETSKLAECIGKTRTLLRKILSEGVDHCMVKLDNDPQGYLSQPLSLLEAVLQECHNTFTACFHSFYPTPALQWACLCDLLNCLDQDIQEANFKTSSSRLLAAVMSALCHTSVKLTSIFPIAYDGEVLLRSIVKQVSTENDSTLVHRFPLLVAHMEKLSQSEENISGMTSFREVLEKMLVIVVLPVRNSLRRENELFSSHLVSNTCGLLASIVSELTASALGSEVDGLNSLHSVKASANRFTKTSQGRSWNTGNGSPDAICFSVDKPGIVVVGFSVYGGGGIHEYELEVLVDDSEHAGDSTHSHRWTSLELVKGTYTTDDSPSDIAEIRLDKVVPLKENVKYAVRLRNYGSRTANGDGGMTTVQCPDGVTFTFSTCSLSSNGTNQTRGQIPQILYYRSEFDGDLQSQLLSKANEEDKNCSRALSVVSTVVRASKDLLHRALAVDADDIPELLSSSSLFSMLLPLIIAYIGPVAAAIPKVAVEVFGLVQQLLPSVAILNQKYAPPAFNPNQSTDSTTGNQPEQGLSACTTSSHYAVIESEHPYKPACVMHYKVTFPECVRWMTIEFDPQCGTAQSEDVLRLLIPVRTVQNSGYGPKLTSVHENLNSWIELKKFSGSSGWPTMVLVLPGNEALFSLETASDYVKDDKASFYGFKCFAIGYEFSPGPDEGVIQLEKELANLGGVCAAALMKKDLALPIGNELEEDLEILEEAALQVCKTHSGILGKGLALSHSPTILEALEGNLPLQIQSNEQSFLDDFIACVPGSSGGRLARWLQPDSYADPQKTSLILNKDDIRCGWPTTITVQTKDQYGDVVHVPNMKVEVKAVPVSQKKMSLQQDQAKKPQRIPGSPAVTAASSNTDMTYGGLASPKLDVSYEPMIVKEARYIAITMMKVYENYSFEELRFASPTPKRPSENMLIRVNNDGTYCANWTPGAIGLYTLHVTIDGIEIDAGLEVKVKDPPKGMIPPGTQLVKPKSEPQPNKVRKFVAKDSAGLRIRSHPSLQSEQIGIVKVNGTITFIDEIHNDDGVWLRLNDETIKKYVPNMNGYTEAWCLSFNQHLGKSLLVPVDNIFNASQGVRDLDVFSWTSKAFFPQESKTNTDDFFKDINSCCPQEATMQEQDMPFLRGGPGMYKVVKTGPSGHNIRSCPNLRGIPIGMLVLGNKVKAVGEVTNSEGTWVQLDQNSMVEFCESDEGEAWSLARDRGGNQYLRHEDEQALLDQNSQTPPPSPFSVQAFNKGASCSAQGFDYGLGNSKGRYLKVSLLLT

SEQ ID NO: 852884 - protein, 84 aa, Homo sapiens
SFYFSYQVTSLLRRVLPEVTPSRLASIIGVKSLPPADISDIIHSTEKGDWNKLGILDMFLGCIAKALTVQLKAKGTTITGTAGT

SEQ ID NO: 852885 - protein, 139 aa, Homo sapiens
MLPLSLLKTAQNHPMLVELKNGETYNGHLVSCDNWMNINLREVICTSRDGDKFWRMPECYIRGSTIKYLRIPDEIIDMVKEEVVAKGRGRGGLQQQKQQKGRGMGGAGRGVFGGRGRGGIPGTGRGQPEKKPGRQAGKQ

SEQ ID NO: 852886 - protein, 153 aa, Homo sapiens
TRGSGRVGRATRATMLPLSLLKTAQNHPMLVELKNGETYNGHLVSCDNWMNINLREVICTSRDGDKFWRMPECYIRGSTIKYLRIPDEIIDMVKEEVVAKGRGRGGLQQQKQQKGRGMGGAGRGVFGGRGRGGIPGTGRGQPEKKPGRQAGKQ

SEQ ID NO: 852887 - protein, 79 aa, Homo sapiens
MLPLSLLKTAQNHPMLVELKNGETYNGHLVSCDNWMNINLREVICTSRVGAAPTNGGGMQGVHTQPPPSLPGPHGRSQW

SEQ ID NO: 852888 - protein, 139 aa, Homo sapiens; identical to SEQ ID NO: 852885

SEQ ID NO: 852889 - protein, 139 aa, Homo sapiens; identical to SEQ ID NO: 852885

SEQ ID NO: 852890 - protein, 178 aa, Homo sapiens
GDPKAVCEGSACPAAVTRTGTDSATARRRTLPPPVPAGTMLPLSLLKTAQNHPMLVELKNGETYNGHLVSCDNWMNINLREVICTSRDGDKFWRMPECYIRGSTIKYLRIPDEIIDMVKEEVVAKGRGRGGLQQQKQQKGRGMGGAGRGVFGGRGRGGIPGTGRGQPEKKPGRQAGKQ

SEQ ID NO: 852891 - protein, 153 aa, Homo sapiens; identical to SEQ ID NO: 852886

SEQ ID NO: 852892 - protein, 174 aa, Homo sapiens
MLPLSLLKTAQNHPMLVELKNGETYNGHLVSCDNWMNINLREVICTSRVKNPNQREPHPRLEGAPVSHSEPGPRAEDEEPVFLDGDKFWRMPECYIRGSTIKYLRIPDEIIDMVKEEVVAKGRGRGGLQQQKQQKGRGMGGAGRGVFGGRGRGGIPGTGRGQPEKKPGRQAGKQ

SEQ ID NO: 852893 - protein, 137 aa, Homo sapiens
EVRSPPDMLLSLLKANPHVVELKWGDVQGHVSCELDELLRSSAQDTDGDKFWRMPECYIRGSTIKYLRIPDEIIDMVKEEVVAKGRGRGGLQQQKQQKGRGMGGAGRGVFGGRGRGGIPGTGRGQPEKKPGRQAGKQ

SEQ ID NO: 852894 - protein, 33 aa, Homo sapiens
MPECYIRGSTIKYLRIPDEIIDMVKEEVVAKGR

SEQ ID NO: 852895 - protein, 114 aa, Homo sapiens
MLPLSLLKTAQNHPMLVELKNGETYNGHLVSCDNWMNINLREVICTSRDGDKFWRMPECYIRGSTIKYLRIPDEIIDMVKEEVVAKGRGTPEALASKLESGSGPVGWAGFGPGW

SEQ ID NO: 852896 - protein, 139 aa, Homo sapiens; identical to SEQ ID NO: 852885

SEQ ID NO: 852897 - protein, 104 aa, Homo sapiens
MNINLREVICTSRDGDKFWRMPECYIRGSTIKYLRIPDEIIDMVKEEVVAKGRGRGGLQQQKQQKGRGMGGAGRGVFGGRGRGGIPGTGRGQPEKKPGRQAGKQ

SEQ ID NO: 852898 - protein, 121 aa, Homo sapiens
YGGYVHTDGPSVLSDEDWITLICEKYLQSVDGDKFWRMPECYIRGSTIKYLRIPDEIIDMVKEEVVAKGRGRGGLQQQKQQKGRGMGGAGRGVFGGRGRGGIPGTGRGQPEKKPGRQAGKQ

SEQ ID NO: 852899 - protein, 150 aa, Homo sapiens
GGVAGLRLCLVHREAPTRSGLWAAGEEPQPERAPSQAGGSPSQPLLSQAHGQRKEPVFLDGDKFWRMPECYIRGSTIKYLRIPDEIIDMVKEEVVAKGRGRGGLQQQKQQKGRGMGGAGRGVFGGRGRGGIPGTGRGQPEKKPGRQAGKQ

SEQ ID NO: 852900 - protein, 108 aa, Homo sapiens
MRGEERRGAASRLGDVPARVGGMRSLGPPGARSLPASRAHPWGREGGRLRTPARDLRESGAQRTGSGCSLALDGKWGIGWGAADPLTWITWCVSAGLRRPTTSSPSVD

SEQ ID NO: 852901 - protein, 108 aa, Homo sapiens; identical to SEQ ID NO: 852900

SEQ ID NO: 852902 - protein, 100 aa, Homo sapiens
SLQRAPSPGLPLHPGTLWSLVRPHDSLGLLSHLWGWSLSPGIWTLGAIDEAWLALLAAMCKTCVPGKAPLSLQRSSESHGRSQQSSKCRLGKSRGLCGGD

SEQ ID NO: 852903 - protein, 108 aa, Homo sapiens; identical to SEQ ID NO: 852900

SEQ ID NO: 852904 - protein, 132 aa, Homo sapiens
SLQRAPSPGLPLHPGTLWSLVRPHDSLGLLSHLWGWSLSPGIWTLGAIDEAWLALLAAMCKTCVPGKAPLSLQRSSESHGRSQQSSKCRLGKSRGLCGGWEGLIHIPTRKFSRTPACHLDPLEGPGSGWTTS

SEQ ID NO: 852905 - protein, 108 aa, Homo sapiens; identical to SEQ ID NO: 852900

SEQ ID NO: 852906 - protein, 108 aa, Homo sapiens; identical to SEQ ID NO: 852900

SEQ ID NO: 852907 - protein, 93 aa, Homo sapiens
HSCSSTQFKCNSGRCIPEHWTCDGDNDCGDYSDEKSCEGVTHVCDPSVKFGCKDSARCISKAWVCDGYQGLWHLVRTLLPQCVLMTHTHLTIA

SEQ ID NO: 852908 - protein, 108 aa, Homo sapiens; identical to SEQ ID NO: 852900

SEQ ID NO: 852909 - protein, 108 aa, Homo sapiens; identical to SEQ ID NO: 852900

SEQ ID NO: 852910 - protein, 108 aa, Homo sapiens; identical to SEQ ID NO: 852900

SEQ ID NO: 852911 - protein, 108 aa, Homo sapiens; identical to SEQ ID NO: 852900

SEQ ID NO: 852912 - protein, 108 aa, Homo sapiens; identical to SEQ ID NO: 852900

SEQ ID NO: 852913 - protein, 433 aa, Homo sapiens
MAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGLLSLLYLPTGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 852914 - protein, 463 aa, Homo sapiens
AGTGPEFLRWQAGVRSSWSFAGVPGAQRLWMAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGLLSLLYLPTGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 852915 - protein, 545 aa, Homo sapiens
MPRKIEEIKDFLLTARRKDAKSVKIKKNKDNVKFKVRCSRYLYTLVITDKEKAEKLKQSLPPGVGSEGTEMNQTHCLELYYIKILKKTGPAGQAGVRSSWSFAGVPGAQRLWMAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGLLSLLYLPTGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 852916 - protein, 547 aa, Homo sapiens
MPPTCSPGLRRQDWAPGRCAGLHLPPRAPSSPALQALAGQAGGERGHPAPGVPGSWRWGLCPEGGHREPGWGWGTASAGKCARFHSGARVELPRASGGPAPPLPKTLRGHSTADPRRQLVREPGVLGITLGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGLLSLLYLPTGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 852917 - protein, 406 aa, Homo sapiens
MAEAQSGTGQLQEQKKGLLIAVSVSVDKIISHFGAARNLVQKVADGLKPFRKDLITGQRRSSPWSVVEASVKPGSSTRSLGTLYSQVSRLAPLSSSRSRFHAFILGLLNTKQLELWFSSLQEDAGLLSLLYLPTGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 852918 - protein, 441 aa, Homo sapiens
MPPTCSPGLRRQDWAPGRCAGLHLPPRAPSSPALQALAGQAGGERGHPAPGVPGSWRWGLCPEGGHREPGWGWGTASAGKCARFHSGARVELPRASGGPAPPLPKTLRGHSTADPRRQLVREPGVLGITLGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 852919 - protein, 482 aa, Homo sapiens
MPPTCSPGLRRQDWAPGRCAGLHLPPRAPSSPALQALAGQAGVRSSWSFAGVPGAQRLWMAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 852920 - protein, 211 aa, Homo sapiens
MQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 852921 - protein, 310 aa, Homo sapiens [sequence omitted]

SEQ ID NO: 852922 - protein, 411 aa, Homo sapiens
MAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGLLSLLYLPTGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERPLPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 852923 - protein, 398 aa, Homo sapiens
PRPPPPPVPPRRKKNRPGLQPIAEGQSEEGRAVSPAAGEEAPAAKEPGAQAGLEVRSSWSFAGVPGAQRLWMAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 852924 - protein, 122 aa, Homo sapiens
MAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPAPSSWSCGFPVSRKMQGAGGSS

SEQ ID NO: 852925 - protein, 136 aa, Homo sapiens
MPLSWASSTPSSWSCGFPVSRKMQACSPSCTCQQDFSPWPAVVVPPCPQSCCSCCSHCRCSLSTWTCSLSTTTTCPWAHLRPLPLQAHLQLCSRLCKPCCTLGAGWPRAFGGLPRKLLQTPLTLQTFPHQGAGGSS

SEQ ID NO: 852926 - protein, 492 aa, Homo sapiens
MPPTCSPGLRRQDWAPGRCAGLHLPPRAPSSPALQALAGQAGVRSSWSFAGVPGAQRLWMAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGLLSLLYLPTGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 852927 - protein, 433 aa, Homo sapiens; identical to SEQ ID NO: 852913

SEQ ID NO: 852928 - protein, 427 aa, Homo sapiens
MRRVMELRGGCGNGWREVAGRCLEGSLEPSASRHLQAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGLLSLLYLPTGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 852929 - protein, 550 aa, Homo sapiens
PRPPPPPVPPRRKKNRPGLQPIAEGQSEEGRAVSPAAGEEAPAAKEPGAQAGLEVRSSWSFAGVPGAQRLWMAEAQSGTGQLQEQKKGLLIAVSVSVDKIISHFGAARNLVQKVKVAGEEAVGMRRVMELRGGCGNGWREVAGRCLEGSLEPSASRHLQAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGLLSLLYLPTGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 852930 - protein, 287 aa, Homo sapiens
MPPTCSPGLRRQDWAPGRCAGLHLPPRAPSSPALQALAGQAGVRSSWSFAGVPGAQRLWMAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPAPSSWSCGFPVSRKMQACSPSCTCQQDFSPWPAVVVPPCPQSCCSCCSHCRCSLSTWTCSLSTTTTCPWAHLRPLPLQAHLQLCSRLCKPCCTLGAGWPRAFGGLPRKLLQTPLTLQTFPHQGAGGSS

SEQ ID NO: 852931 - protein, 350 aa, Homo sapiens
CHLGTYRLRIVFWRSTVRWPNTVRWPLGHAVSRLAPLSSSRSRFHAFILGLLNTKQLELWFSSLQEDAGLLSLLYLPTGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 852932 - protein, 433 aa, Homo sapiens; identical to SEQ ID NO: 852913

SEQ ID NO: 852933 - protein, 386 aa, Homo sapiens
MPPTCSPGLRRQDWAPGRCAGLHLPPRAPSSPALQALAGQAGVRSSWSFAGVPGAQRLWMAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 852934 - protein, 91 aa, Homo sapiens
GTGHLFEVTVLRPVVLTTGSELQLAPVLASGGADPLPSHSTGPCVDCQLAIHAWRRGEVLRVITTVDEDWLRCGRDGMEGLVPVGYTSLVL

SEQ ID NO: 852935 - protein, 70 aa, Homo sapiens
HALVADGLKPFRKDLITGQRRSSPWSVVEASVKPGEPGGRGTRQCAGQGRAWLTAPHVLRLQHPLPWNPV

SEQ ID NO: 852936 - protein, 27 aa, Homo sapiens
MGPQRRVWLSSGNMVLSQFLGDIQWHL

SEQ ID NO: 852937 - protein, 538 aa, Homo sapiens
MAQKPLRLLACGDVEGKFDILFNRVQAIQKKSGNFDLLLCVGNFFGSTQDAEWEEYKTGIKKAPIQTYVLGANNQETVKYFQDADGCELAENITYLGRKGIFTGSSGLQIVYLSGTESLNEPVPGYSFSPKDVSSLRMMLCTTSQFKGVDILLTSPWPKCVGNFGNSSGEVDTKKCGSALVSSLATGLKPRYHFAALEKTYYERLPYRNHIILQENAQHATRFIALANVGNPEKKKYLYAFSIVPMKLMDAAELVKQPPDVTENPYRKSGQEASIGKQILAPVEESACQFFFDLNEKQGRKRSSTGRDSKSSPHPKQPRKPPQPPGPCWFCLASPEVEKHLVVNIGTHCYLALAKGGLSDDHVLILPIGHYQSVVELSAEVVEEVEKYKATLRRFFKSRGKWCVVFERNYKSHHLQLQVIPVPISCSTTDDIKDAFITQAQEQQIELLEIPEHSDIKQIAQPGAAYFYVELDTGEKLFHRIKKNFPLQFGREVLASEAILNVPDKSDWRQCQISKEDEETLARRFRKDFEPYDFTLDD

SEQ ID NO: 852938 - protein, 504 aa, Homo sapiens
MAQKPLRLLACGDVEGKFDILFNRVQAIQKKSGNFDLLLCVGNFFGSTQDAEWEEYKTGIKKGRKGIFTGSSGLQIVYLSGTESLNEPVPGYSFSPKDVSSLRMMLCTTSQFKGVDILLTSPWPKCVGNFGNSSGEVDTKKCGSALVSSLATGLKPRYHFAALEKTYYERLPYRNHIILQENAQHATRFIALANVGNPEKKKYLYAFSIVPMKLMDAAELVKQPPDVTENPYRKSGQEASIGKQILAPVEESACQFFFDLNEKQGRKRSSTGRDSKSSPHPKQPRKPPQPPGPCWFCLASPEVEKHLVVNIGTHCYLALAKGGLSDDHVLILPIGHYQSVVELSAEVVEEVEKYKATLRRFFKSRGKWCVVFERNYKSHHLQLQVIPVPISCSTTDDIKDAFITQAQEQQIELLEIPEHSDIKQIAQPGAAYFYVELDTGEKLFHRIKKNFPLQFGREVLASEAILNVPDKSDWRQCQISKEDEETLARRFRKDFEPYDFTLDD

SEQ ID NO: 852939 - protein, 383 aa, Homo sapiens
MLNGRSIRLASRKGEVDTKKCGSALVSSLATGLKPRYHFAALEKTYYERLPYRNHIILQENAQHATRFIALANVGNPEKKKYLYAFSIVPMKLMDAAELVKQPPDVTENPYRKSGQEASIGKQILAPVEESACQFFFDLNEKQGRKRSSTGRDSKSSPHPKQPRKPPQPPGPCWFCLASPEVEKHLVVNIGTHCYLALAKGGLSDDHVLILPIGHYQSVVELSAEVVEEVEKYKATLRRFFKSRGKWCVVFERNYKSHHLQLQVIPVPISCSTTDDIKDAFITQAQEQQIELLEIPEHSDIKQIAQPGAAYFYVELDTGEKLFHRIKKNFPLQFGREVLASEAILNVPDKSDWRQCQISKEDEETLARRFRKDFEPYDFTLDD

SEQ ID NO: 852940 - protein, 383 aa, Homo sapiens; identical to SEQ ID NO: 852939

SEQ ID NO: 852941 - protein, 538 aa, Homo sapiens; identical to SEQ ID NO: 852937

SEQ ID NO: 852942 - protein, 177 aa, Homo sapiens
MAQKPLRLLACGDVEGKFDILFNRVQAIQKKSGNFDLLLCVGNFFGSTQDAEWEEYKTGIKKAPIQTYVLGANNQETVKYFQDADGCELAENITYLGRKGIFTGSSGLQIVYLSGTESLNEPVPGYSFSPKDVSSLRMMLCTTSQFKGVDILLTSPWPKCVGNFGNSSVSSVCLVGI

SEQ ID NO: 852943 - protein, 538 aa, Homo sapiens; identical to SEQ ID NO: 852937

SEQ ID NO: 852944 - protein, 293 aa, Homo sapiens
MKLMDAAELVKQPPDVTENPYRKSGQEASIGKQILAPVEESACQFFFDLNEKQGRKRSSTGRDSKSSPHPKQPRKPPQPPGPCWFCLASPEVEKHLVVNIGTHCYLALAKGGLSDDHVLILPIGHYQSVVELSAEVVEEVEKYKATLRRFFKSRGKWCVVFERNYKSHHLQLQVIPVPISCSTTDDIKDAFITQAQEQQIELLEIPEHSDIKQIAQPGAAYFYVELDTGEKLFHRIKKNFPLQFGREVLASEAILNVPDKSDWRQCQISKEDEETLARRFRKDFEPYDFTLDD

SEQ ID NO: 852945 - protein, 498 aa, Homo sapiens
MAQKPLRLLACGDVEGKFDILFNRVQAIQKKSGNFDLLLCVGNFFGSTQDAEWEEYKTGIKKAPIQTYVLGANNQETVKYFQDADGCELAENITYLGRKGIFTGSSGLQIVYLSGTESLNEPVPGYSFSPKDVSSLRMMLCTTSQFKGVDILLTSPWPKCVGNFGNSSGEVDTKKCGSALVSSLATGLKPRYHFAALEKTYYERLPYRNHIILQENAQHATRFIALANVGNPEKKKYLYAFSIVPMKLMDAAELVKQPPDVTENPYRKSGQEASIGKQILAPVEESACQFFFDLNEKQGRKRSSTGRDSKSSPHPKQPRKPPQPPGPCWFCLASPEVEKHLVVNIGTHCYLALAKGGLSDDHVLILPIGHYQSVVELSAEVVEEVEKYKATLRRFFKSRGKWCVVFERNYKSHHLQLQIAQPGAAYFYVELDTGEKLFHRIKKNFPLQFGREVLASEAILNVPDKSDWRQCQISKEDEETLARRFRKDFEPYDFTLDD

SEQ ID NO: 852946 - protein, 345 aa, Homo sapiens
MAQKPLRLLACGDVEGKFDILFNRVQAIQKKSGNFDLLLCVGNFFGSTQDAEWEEYKTGIKKAPIQTYVLGANNQETVKYFQDADGCELAENITYLGRKGIFTGSSGLQIVYLSGTESLNEPVPGYSFSPKDVSSLRMMLCTTSQFKGVDILLTSPWPKCVGNFGNSSGEVDTKKCGSALVSSLATGLKPRYHFAALEKTYYERLPYRNHIILQENAQHATRFIALANVGNPEKKKYLYAFSIVPMKLMDAAELVKQPPDVTENPYRKSGQEASIGKQILAPVEESACQFFFDLNEKQGRKRSSTGRDSKSSPHPKQPRKPPQPPGPCWFCLDSSLGDSETPSQK

SEQ ID NO: 852947 - protein, 461 aa, Homo sapiens
AAGRKTGVQPFEVSPPTSCCLTVAVADPGVSEGFRGFGAGCEMPGRGRCPDCGSTELVEDSHYSQSQLVCSDCGCVVTEGVLTTTFSDEGNLREVTYSRSTGENEQVSRSQQRGLRRVRDLCRVLQLPPTFEDTAVAYYQQAYRHSGIRAARLQKKEVLVGCCVLITCRQHNWPLTMGAICTLLYADLDVFSSTYMQIVKLLGLDVPSLCLAELVKTYCSSFKLFQASPSVPAKYVEDKEKMLSRTMQLVELANETWLVTGRHPLPVITAATFLAWQSLQPADRLSCSLARFCKLANVDLPYPASSRLQELLAVLLRMAEQLAWLRVLRLDKRSVVKHIGDLLQHRQSLVRSAFRDGTAEVETREKEPPGWGQGQGEGEVGNNSLGLPQGKRPASPALLLPPCMLKSPKRICPVPPVSTVTGDENISDSEIEQYLRTPQEVRDFQRAQAARQAATSVPNPP

SEQ ID NO: 852948 - protein, 491 aa, Homo sapiens
AAGRKTGVQPFEVSPPTSCCLTVAVADPGVSEGFRGFGAGCEMPGRGRCPDCGSTELVEDSHYSQSQLVCSDCGCVVTEGVLTTTFSDEGNLREVTYSRSTGENEQVSRSQQRGLRRVRDLCRVLQLPPTFEDTAVAYYQQAYRHSGIRAARLQKKEVLVGCCVLITCRQHNWPLTMGAICTLLYADLDVFSSTYMQIVKLLGLDVPSLCLAELVKTYCSSLECSGTIIAHCSLELMELKRSAHLILPKCSFKLFQASPSVPAKYVEDKEKMLSRTMQLVELANETWLVTGRHPLPVITAATFLAWQSLQPADRLSCSLARFCKLANVDLPYPASSRLQELLAVLLRMAEQLAWLRVLRLDKRSVVKHIGDLLQHRQSLVRSAFRDGTAEVETREKEPPGWGQGQGEGEVGNNSLGLPQGKRPASPALLLPPCMLKSPKRICPVPPVSTVTGDENISDSEIEQYLRTPQEVRDFQRAQAARQAATSVPNPP

SEQ ID NO: 852949 - protein, 295 aa, Homo sapiens
AAGRKTGVQPFEVSPPTSCCLTVAVADPGVSEGFRGFGAGCEMPGRGRCPDCGSTELVEDSHYSQSQLVCSDCGCVVTEGVLTTTFSDEGNLREVTYSRSTGENEQVSRSQQRGLRRVRDLCRVLQLPPTFEDTAVAYYQQAYRHSGIRAARLQKKEVLVGCCVLITCRQHNWPLTMGAICTLLYADLDVFSSTYMQIVKLLGLDVPSLCLAELVKTYCSSFKLFQASPSVPAKYVEDKEKMLSRTMQLVELANETWLVTGRHPLPVNQRNFSLALGNSPANLKGFQRFPLCPNF

SEQ ID NO: 852950 - protein, 461 aa, Homo sapiens; identical to SEQ ID NO: 852947

SEQ ID NO: 852951 - protein, 215 aa, Homo sapiens [sequence omitted]

SEQ ID NO: 852952 - protein, 546 aa, Homo sapiens
MGRRGSAPGNGRTLRGCERGGRRRRSAADSVMAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKVKVLKCISEVQANNVVLGQYVGNPDGEGEATKGYLDDPTVPRGSTTATFAAVVLYVENERWDGVPFILRCGKALNERKAEVRLQFHDVAGDIFHQQCKRNELVIRVQPNEAVYTKMMTKKPGMFFNPEESELDLTYGNRYKNVKLPDAYERLILDVFCGSQMHFVRSDELREAWRIFTPLLHQIELEKPKPIPYIYGSRGPTEADELMKRVGFQYEGTYKWVNPHKL

SEQ ID NO: 852953 - protein, 542 aa, Homo sapiens
MKTIGWVRGRWLGCERGGRRRRSADSVMAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKVKVLKCISEVQANNVVLGQYVGNPDGEGEATKGYLDDPTVPRGSTTATFAAVVLYVENERWDGVPFILRCGKALNERKAEVRLQFHDVAGDIFHQQCKRNELVIRVQPNEAVYTKMMTKKPGMFFNPEESELDLTYGNRYKNVKLPDAYERLILDVFCGSQMHFVRSDELREAWRIFTPLLHQIELEKPKPIPYIYGSRGPTEADELMKRVGFQYEGTYKWVNPHKL

SEQ ID NO: 852954 - protein, 542 aa, Homo sapiens; identical to SEQ ID NO: 852953

SEQ ID NO: 852955 - protein, 370 aa, Homo sapiens
MKTIGWVRGRWLGCERGGRRRRSADSVMAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKVKVLKCISEVQANNVVLGQYVGNPDGEGEATKGYLDDPTVPRGSTTASSASATSW

SEQ ID NO: 852956 - protein, 560 aa, Homo sapiens
MKTIGWVRGRWLGCERGGRRRRSADSVMAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKVKVLKCISEVQANNVVLGQYVGNPDGEGEATKGYLDDPTVPRGSTTATFAAVVLYVENERWDGMVMPSRPSKAELGMPCVRALELPLRHSRTGPHPERAGAEAALSSHVGVPFILRCGKALNERKAEVRLQFHDVAGDIFHQQCKRNELVIRVQPNEAVYTKMMTKKPGMFFNPEESELDLTYGNRYKNVKLPDAYERLILDVFCGSQMHFVRSDELREAWRIFTPLLHQIELEKPKPIPYIYGR

SEQ ID NO: 852957 - protein, 540 aa, Homo sapiens
MKTIGWVRGRWLGCERGGRRRRSADSVMAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKVKVLKCISEVQANNVVLGQYVGNPDGEGEATKGYLDDPTVPRGSTTATFAAVVLYVENERWDGVPFILRCGKALNERKAEVRLQFHDVAGDIFHQQCKRNELVIRVQPNEAVYTKMMTKKPGMFFNPEESELDLTYGNRYKNVKLPDAYERLILDVFCGSQMHFVRSDELREAWRIFTPPCPGEVSTFTDIVRHSPMPSAQLSLDSKRSLFLFSHDTDKRYYHLS

SEQ ID NO: 852958 - protein, 438 aa, Homo sapiens
MKTIGWVRGRWLGCERGGRRRRSADSVMAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKVKVLKCISEVQANNVVLGQYVGNPDGEGEATKGYLDDPTVPRGSTTATFAAVVLYVENERWDGVPFILRCGKALNERKAEVRLQFHDVAGDIFHQQCKRNELVIRVQPNEAVYTKMMTSLSAT

SEQ ID NO: 852959 - protein, 402 aa, Homo sapiens
MKTIGWVRGRWLGCERGGRRRRSADSVMAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKTELGRHAHEGRVAPAIKTFRMRALVYASGSVPALVFCGRRSGSRSDRLVGLESLRGFWVLIVVYTASLGWTRNTSLVALAVLGGDVG

SEQ ID NO: 852960 - protein, 363 aa, Homo sapiens
MKTIGKVRGRWLGCERGGRRRRSADSVMAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKTAAKVAVVDPRGTVGSSRYPLVASPSPSGFPTYCPTTTVVACTSEITQ

SEQ ID NO: 852961 - protein, 234 aa, Homo sapiens
RTREAGEKCEAAVGPHPAPERSLSPPGSAGPRKLADSVMAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHTTLTQKGNASTRETFGKELKKSWNCANTIPLCFLEEPKYRI

SEQ ID NO: 852962 - protein, 546 aa, Homo sapiens; identical to SEQ ID NO: 852952

SEQ ID NO: 852963 - protein, 553 aa, Homo sapiens
RTREAGEKCEAAVGPHPAPERSLSPPGSAGPRKLADSVMAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKVKVLKCISEVQANNVVLGQYVGNPDGEGEATKGYLDDPTVPRGSTTATFAAVVLYVENERWDGVPFILRCGKALNERKAEVRLQFHDVAGDIFHQQCKRNELVIRVQPNEAVYTKMMTKKPGMFFNPEESELDLTYGNRYKNVKLPDAYERLILDVFCGSQMHFVRSDELREAWRIFTPLLHQIELEKPKPIPYIYGSRGPTEADELMKRVGFQYEGTYKWVNPHKL

SEQ ID NO: 852964 - protein, 542 aa, Homo sapiens; identical to SEQ ID NO: 852953

SEQ ID NO: 852965 - protein, 595 aa, Homo sapiens
MKTIGWVRGRWLGCERGGRRRRSADSVMAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKVKVLKCISEVQANNVVLGQYVGNPDGEGEATKGYLDDPTVPRGSTTATFAAVVLYVENERWDGVPFILRCGKALNERKAEVRLQFHDVAGDIFHQQCKRNELVIRVQPNEAVYTKMMTKKPGMFFNPEESELDLTYGNRYKNVKLPDARVGGRDKGEERGEHPRERICLWPCPPASVPLDIPCHQQHLEPPGCPLSHQLCTPWPPRATRRQPLCYKKSRRSSWDPSQPQCPAIKSANSPSCPLVICFPEDPLPCPTPQVTRVLPLWPLRSLLTSGSDPMS

SEQ ID NO: 852966 - protein, 432 aa, Homo sapiens
MKTIGWVRGRWLGCERGGRRRRSADSVMAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKVKVLKCISEVQANNVVLGQYVGNPDGEGEATKGYLDDPTVPRGSTTAQPLCYKKSRRSSWDPSQPQCPAIKSANSPSCPLVICFPEDPLPCPTPQVTRVLPLWPLRSLLTSGSDPMS

SEQ ID NO: 852967 - protein, 289 aa, Homo sapiens
MGRRGSAPGNGRTLRGCERGGRRRRSAADSVMAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRE

SEQ ID NO: 852968 - protein, 491 aa, Homo sapiens
GLVVSRDGAPDGGIEQMGLAMEHGGSYARAGGSSRGCWYYLRYFFLFVSLIQFLIILGLVLFMVYGNVHVSTESNLQATERRAEGLYSQLLGLTASQSNLTKELNFTTRAKDAIMQMWLNARRDLDRINASFRQCQGDRVIYTNNQRYMAAIILSEKQCRDQFKDMNKSCDGECKAAGSRGGGLPAQCSRQPPIFLGLLVLFSLALLFMLNQKVKTLEVEIAKEKTICTKDKESVLLNKRVAEEQLVECVKTRELQHQERQLAKEQLQKVQALCLPLDKDKFEMDLRNLWRDSIIPRSLDNLGYNLYHPLGSELASIRRACDHMPSLMSSKVEELARSLRADIERVARENSDLQRQKLEAQQGLRASQEAKQKVEKEAQAREAKLQAECSRQTQLALEEKAVLRKERDNLAKELEEKKREAEQLRMELAIRNSALDTCIKTKSQPMMPVSRPMGPVPNPQPIDPASLEEFKRKILESQRPPAGIPVAPSSG

SEQ ID NO: 852969 - protein, 458 aa, Homo sapiens
GLVVSRDGAPDGGIEQMGLAMEHGGSYARAGGSSRGCWYYLRYFFLFVSLIQFLIILGLVLFMVYGNVHVSTESNLQATERRAEGLYSQLLGLTASQSNLTKELNFTTRAKDAIMQMWLNARRDLDRINASFRQCQGDRVIYTNNQRYMAAIILSEKQCRDQFKDMNKSCDALLFMLNQKVKTLEVEIAKEKTICTKDKESVLLNKRVAEEQLVECVKTRELQHQERQLAKEQLQKVQALCLPLDKDKFEMDLRNLWRDSIIPRSLDNLGYNLYHPLGSELASIRRACDHMPSLMSSKVEELARSLRADIERVARENSDLQRQKLEAQQGLRASQEAKQKVEKEAQAREAKLQAECSRQTQLALEEKAVLRKERDNLAKELEEKKREAEQLRMELAIRNSALDTCIKTKSQPMMPVSRPMGPVPNPQPIDPASLEEFKRKILESQRPPAGIPVAPSSG

SEQ ID NO: 852970 - protein, 148 aa, Homo sapiens
MTSHRDAATTSRAMSTSHILMSHRRGDGITQTVMMSHTDTVTTHTMTTTPIDMAPTSHARMPFHTHFLPNSHLVSRSPDPGTRAKVPTGSHPLPHSPGPQHLPSSSFLASQPLPHPQCLDPEVRTGSHSPPLLERECFQDPLGALSRG

SEQ ID NO: 852971 - protein, 192 aa, Homo sapiens
GLVVSRDGAPDGGIEQMGLAMEHGGSYARAGGSSRGCWYYLRYFFLFVSLIQFLIILGLVLFMVYGNVHVSTESNLQATERRAEGLYSQLLGLTASQSNLTKELNFTTRAKDAIMQMWLNARRDLDRINASFRQCQGDRVIYTNNQRYMAAIILSEKQCRDQFKDMNKSCDALLFMLNQKVKTNRKPFTSAP

SEQ ID NO: 852972 - protein, 458 aa, Homo sapiens; identical to SEQ ID NO: 852969

SEQ ID NO: 852973 - protein, 148 aa, Homo sapiens; identical to SEQ ID NO: 852970

SEQ ID NO: 852974 - protein, 403 aa, Homo sapiens
GLVVSRDGAPDGGIEQMGLAMEHGGSYARAGGSSRGCWYYLRYFFLFVSLIQFLIILGLVLFMVYGNVHVSTESNLQATERRAEGLYSQLLGLTASQSNLTKELNFTTRAKDAIMQMWLNARRDLDRINASFRQCQGDRVIYTNNQRYMAAIILSEKQCRDQFKDMNKSCDALLFMLNQKVKTLEVEIAKEKTICTKDKESVLLNKRVAEEQLVECVKTRELQHQERQLAKEQLQKVQALCLPLDKDKFEMDLRNLWRDSIIPRSLDNLGYNLYHPLGSELASIRRACDHMPSLMSSKVEELARSLRADIERVARENSDLQRQKLEAQQGLRASQEAKQKVEKEAQAREAKLQAECSRQTQFLASQPLPHPQCLDPEVRTGSHSPPLLERECFQDPLGALSRG

SEQ ID NO: 852975 - protein, 233 aa, Homo sapiens
RLPRSPARPSCRPCRARRSSAAFPAESVSPRRWVGLGSAAMGKQNSKLRPEMLQDLRENTEFSELELQEWYKGFLKDCPTGILNVDEFKKIYANFFPYGDASKFAEHVFRTFDTNSDGTIDFREFIIALSVTSRGRLEQKLMWAFSMYDLDGNGYISREEMLEIVQAIYKMVSSVMKMPEDESTPEKRTEKIFRQMDTNNDGKLSLEEFIRGAKSDPSIVRLLQCDPSSASQF

SEQ ID NO: 852976 - protein, 233 aa, Homo sapiens; identical to SEQ ID NO: 852975

SEQ ID NO: 852977 - protein, 192 aa, Homo sapiens
RLPRSPARPSCRPCRARRSSAAFPAESVSPRRWVGLGSAAMGKQNSKLRPEMLQDLRENTEFSELELQEWYKGFLKDCPTGILNVDEFKKIYANFFPYGDASKFAEHVFRTFDTNSDGTIDFREFIIALSVTSRGRLEQKLMWAFSMYDLDGNGYISREEMLEIVQSTVQLCLVDPHLHQRKRMLREIKALA

SEQ ID NO: 852978 - protein, 214 aa, Homo sapiens
PDHSSLPLTPLGTQVGLGSAAMGKQNSKLRPEMLQDLRENTEFSELELQEWYKGFLKDCPTGILNVDEFKKIYANFFPYGDASKFAEHVFRTFDTNSDGTIDFREFIIALSVTSRGRLEQKLMWAFSMYDLDGNGYISREEMLEIVQAIYKMVSSVMKMPEDESTPEKRTEKIFRQMDTNNDGKLSLEEFIRGAKSDPSIVRLLQCDPSSASQF

SEQ ID NO: 852979 - protein, 100 aa, Homo sapiens
RLPRSPARPSCRPCRARRSSAAFPAESVSPRRWAIYKMVSSVMKMPEDESTPEKRTEKIFRQMDTNNDGKLSLEEFIRGAKSDPSIVRLLQCDPSSASQF

SEQ ID NO: 852980 - protein, 147 aa, Homo sapiens
MWKFPGGLSEPEEDIGDTAVREVFEETGIKSEFRSVLSIRQQHTNPGAFGKSDMYIICRLKPYSFTINFCQEECLRCEWMDLNDLAKTENTTPITSRVARLLLYGYREGFDKIDLTVEELPAVYTGLFYKLYHKELPENYKTMKGID

SEQ ID NO: 852981 - protein, 184 aa, Homo sapiens
IWATDESSGVEMRQPLSWGRWRAMLARTYGPGPSAGYRWASGAQGYVRNPPVGACDLQGELDRFGGISVRLARLDALDRLDAAAFQKGLQAAVQQWRSEGRTAVWLHIPILQSRFIAPAASLGFCFHHAESDSSTLTLWLREGPSRLPGYASHQVGVAGAVFDESTRKILVVQDRNKVSCFCFI

SEQ ID NO: 852982 - protein, 162 aa, Homo sapiens
VGELTLFFNPDQLKNMWKFPGGLSEPEEDIGDTAVREVFEETGIKSEFRSVLSIRQQHTNPGAFGKSDMYIICRLKPYSFTINFCQEECLRCEWMDLNDLAKTENTTPITSRVARLLLYGYREGFDKIDLTVEELPAVYTGLFYKLYHKELPENYKTMKGID

SEQ ID NO: 852983 - protein, 327 aa, Homo sapiens
IWATDESSGVEMRQPLSWGRWRAMLARTYGPGPSAGYRWASGAQGYVRNPPVGACDLQGELDRFGGISVRLARLDALDRLDAAAFQKGLQAAVQQWRSEGRTAVWLHIPILQSRFIAPAASLGFCFHHAESDSSTLTLWLREGPSRLPGYASHQVGVAGAVFDESTRKILVVQDRNKLKNMWKFPGGLSEPEEDIGDTAVREVFEETGIKSEFRSVLSIRQQHTNPGAFGKSDMYIICRLKPYSFTINFCQEECLRCEWMDLNDLAKTENTTPITSRVARLLLYGYREGFDKIDLTVEELPAVYTGLFYKLYHKELPENYKTMKGID

SEQ ID NO: 852984 - protein, 147 aa, Homo sapiens; identical to SEQ ID NO: 852980

SEQ ID NO: 852985 - protein, 327 aa, Homo sapiens; identical to SEQ ID NO: 852983

SEQ ID NO: 852986 - protein, 328 aa, Homo sapiens
CSEPPPSPETPLAWGLRTATPLPPESPPRHSLEEEPAGNWLQDALFLSAACSCNQHARRCRFNSELFRLSGGRSGGVCERCRHHTAGRHCHYCQPGFWRDPSQPIFSRRACRACQCHPIGATGGTCNQTSGQCTCKLGVTGLTCNRCGPGYQQSRSPRMPCQRIPEATTTLATTPGAYSSDPQCQNYCNMSDTRVHMSLRRYCQQDHVLRAQVLASEAAGPAWQRLAVRVLAVYKQRAQPVRRGDQDAWVPRADLTCGCLRLQPGTDYLLLGSAVGDPDPTRLILDRHGLALPWRPRWARPLKRLQQEERAGGCRGVRAPTPSPRPEH

SEQ ID NO: 852987 - protein, 239 aa, Homo sapiens
CSEPPPSPETPLAWGLRTATPLPPESPPRHSLEEEPAGNWLQDALFLSAACSCNQHARRCRFNSELFRLSGGRSGGVCERCRHHTAGRHCHYCQPGFWRDPSQPIFSRRACRACQCHPIGATGGTCNQTSGQCTCKLGVTGLTCNRCGPGYQQSRSPRMPCQRIPEATTTLATTPGAYSSDPQCQNYCNMSDTRVHMSLRRYCQQDHGECWGDRQLKATQLVLMTASKPPPFWPSTFSS

SEQ ID NO: 852988 - protein, 445 aa, Homo sapiens
AWWRIRHEAATPLPPESPPRHSLEEEPAGNWLQDALFLSAGAGSAVTMPVTFALLLLLGQATADPCYDPQGRPQFCLPPVTQLAAVAASCPQACALSPGNHLGARETCNGSLTLALGGPFLLTSVSLRFCTPGPPALILSAAWASGGPWRLLWHRPAWPGALGGPERVTFHSTPGPKATVAASHLRVEFGGQAGLAAAGLRGRCQCHGHAARCAARARPPRCTAATYHWPGVRELAAVPSRLALAAARPGPQPCLPCSCNQHARRCRFNSELFRLSGGRSGGVCERCRHHTAGRHCHYCQPGFWRDPSQPIFSRRACRACQCHPIGATGGTCNQTSGQCTCKLGVTGLTCNRCGPGYQQSRSPRMPCQRIPEATTTLATTPGAYSSDPQCQNYCNMSDTRVHMSLRRYCQQDHGECWGDRQLKATQLVLMTASKPPPFWPSTFSS

SEQ ID NO: 852989 - protein, 534 aa, Homo sapiens
AWWRIRHEAATPLPPESPPRHSLEEEPAGNWLQDALFLSAGAGSAVTMPVTFALLLLLGQATADPCYDPQGRPQFCLPPVTQLAAVAASCPQACALSPGNHLGARETCNGSLTLALGGPFLLTSVSLRFCTPGPPALILSAAWASGGPWRLLWHRPAWPGALGGPERVTFHSTPGPKATVAASHLRVEFGGQAGLAAAGLRGRCQCHGHAARCAARARPPRCTAATYHWPGVRELAAVPSRLALAAARPGPQPCLPCSCNQHARRCRFNSELFRLSGGRSGGVCERCRHHTAGRHCHYCQPGFWRDPSQPIFSRRACRACQCHPIGATGGTCNQTSGQCTCKLGVTGLTCNRCGPGYQQSRSPRMPCQRIPEATTTLATTPGAYSSDPQCQNYCNMSDTRVHMSLRRYCQQDHVLRAQVLASEAAGPAWQRLAVRVLAVYKQRAQPVRRGDQDAWVPRADLTCGCLRLQPGTDYLLLGSAVGDPDPTRLILDRHGLALPWRPRWARPLKRLQQEERAGGCRGVRAPTPSPRPEH

SEQ ID NO: 852990 - protein, 405 aa, Homo sapiens
SHTGGAQAGSAEGPAPESRSSTLTHTAWAPSSDMPPLMGGVSAPFHPPAADAPPSFRSDSLLSNPMSLSCSCQIWPPPTWYLRVQSRGSPLLCPRTPWGRAWGSGSQACQDWAHATPRKRWGQATADPCYDPQGRPQFCLPPVTQLAAVAASCPQACALSPGNHLGARETCNGSLTLALGGPFLLTSVSLRFCTPGPPALILSAAWASGGPWRLLWHRPAWPGALGGPERVTFHSTPGPKATVAASHLRVEFGGQAGLAAAGLRGRCQCHGHAARCAARARPPRCTAATYHWPGVRELPPSHRDWPWRLHAPDPNLAYPAPATSTPDAAGSTLSCSDCRAAGVGVFVSGAATTQLGGTATTANLGSGGTLASLSSAAGPAEPASATLLGQQEEPATRPVGSAPAS

SEQ ID NO: 852991 - protein, 805 aa, Homo sapiens
MWDQGGQPWQQWPLNQQQWMQSFQHQQDPSQIDWAALAQAWIAQREASGQQSMVEQPPGMMPNGQDMSTMESGPNNHGNFQGDSNFNRMWQPEWGMHQQPPHPPPDQPWMPPTPGPMDIVPPSEDSNSQDSGEFAPDNRHIFNQNNHNFGGPPDNFAVGPVNQFDYQHGAAFGPPQGGFHPPYWQPGPPGPPAPPQNRRERPSSFRDRQRSPIALPVKQEPPQIDAVKRRTLPAWIREGLEKMEREKQKKLEKERMEQQRSQLSKKEKKATEDAEGGDGPRLPQRSKFDSDEEEEDTENVEAASSGKVTRSPSPVPQEEHSDPEMTEEEKEYQMMLLTKMLLTEILLDVTDEEIYYVAKDAHRKATKAPAKQLAQSSALASLTGLGGLGGYGSGDSEDERSDRGSESSDTDDEELRHRIRQKQEAFWRKEKEQQLLHDKQMEEEKQQTERVTKEMNEFIHKEQNSLSLLEAREADGDVVNEKKRTPNETTSVLEPKKEHKEKEKQGRSRSGSSSSGSSSSNSRTSSTSSTVSSSSYSSSSGSSRTSSRSSSPKRKKRHSRSRSPTIKARRSRSRSYSRRIKIESNRARVKIRDRRRSNRNSIERERRRNRSPSRERRRSRSRSRDRRTNRASRSRSRDRRKIDDQRGNLSGNSHKHKGEAKEQERKKERSRSIDKDRKKKDKEREREQDKRKEKQKREEKDFKFSSQDDRLKRKRESERTFSRSGSISVKIIRHDSRQDSKKSTTKDSKKHSGSDSSGRSSSESPGSSKEKKAKKPKHSRSRSVEKSQRSGKKASRKHKSKSRSR

SEQ ID NO: 852992 - protein, 805 aa, Homo sapiens; identical to SEQ ID NO: 852991

SEQ ID NO: 852993 - protein, 805 aa, Homo sapiens; identical to SEQ ID NO: 852991

SEQ ID NO: 852994 - protein, 805 aa, Homo sapiens; identical to SEQ ID NO: 852991

SEQ ID NO: 852995 - protein, 814 aa, Homo sapiens
MWDQGGQPWQQWPLNQQQWMQSFQHQQDPSQIDWAALAQAWIAQREASGQQSMVEQPPGMMPNGQDMSTMESGPNNHGNFQGDSNFNRMWQPEWGMHQQPPHPPPDQPWMPPTPGPMDIVPPSEDSNSQDSGEFAPDNRHIFNQNNHNFGGPPDNFAVGPVNQFDYQHGAAFGPPQGGFHPPYWQPGPPGPPAPPQNRRERPSSFRDRQRSPIALPVKQEPPQIDAVKRRTLPAWIREGLEKMEREKQKKLEKERMEQQRSQLSKKEKKATEDAEGGDGPRLPQRSKFDSDEEEEDTENVEAASSGKVTRSPSPVPQEEHSDPEMTEEEKEYQMMLLTKMLLTEILLDVTDEEIYYVAKDAHRKATKAPAKQLAQSSALASLTGLGGLGGYGSGDSEDERSDRGSESSDTDDEELRHRIRQKQEAFWRKEKEQQLLHDKQMEEEKQQTERVTKEMNEFIHKEQNSLSLLEAREADGDVVNEKKRTPNETTSVLEPKKEHKEKEKQGRSRSGSSSSGSSSSNSRTSSTSSTVSSSSYSSSSGSSRTSSRSSSPKRKKRHSRSRSPTIKARRSRSRSYSRRIKIESNRARVKIRDRRRSNRNSIERERRRNRSPSRERRRSRSRSRDRRTNRASRSRSRDRRKIDDQRGNLSGNSHKHKGEAKEQERKKERSRSIDKDRKKKDKEREREQDKRKEKQKREEKDFKFSSQDDRLKRKRESERTFSRSGSISVKIIRHDSRQDSKKSTTKDSKKHSGSDSSGRSSSESPGSSKEKKAKKPKHSRSRSVEKSQRSGKKASRKHKSKSRSRSTTPPRRKR

SEQ ID NO: 852996 - protein, 814 aa, Homo sapiens; identical to SEQ ID NO: 852995

SEQ ID NO: 852997 - protein, 805 aa, Homo sapiens; identical to SEQ ID NO: 852991

SEQ ID NO: 852998 - protein, 805 aa, Homo sapiens; identical to SEQ ID NO: 852991

SEQ ID NO: 852999 - protein, 563 aa, Homo sapiens
MEREKQKKLEKERMEQQRSQLSKKEKKATEDAEGGDGPRLPQRSKFDSDEEEEDTENVEAASSGKVTRSPSPVPQEEHSDPEMTEEEKEYQMMLLTKMLLTEILLDVTDEEIYYVAKDAHRKATKAPAKQLAQSSALASLTGLGGLGGYGSGDSEDERSDRGSESSDTDDEELRHRIRQKQEAFWRKEKEQQLLHDKQMEEEKQQTERVTKEMNEFIHKEQNSLSLLEAREADGDVVNEKKRTPNETTSVLEPKKEHKEKEKQGRSRSGSSSSGSSSSNSRTSSTSSTVSSSSYSSSSGSSRTSSRSSSPKRKKRHSRSRSPTIKARRSRSRSYSRRIKIESNRARVKIRDRRRSNRNSIERERRRNRSPSRERRRSRSRSRDRRTNRASRSRSRDRRKIDDQRGNLSGNSHKHKGEAKEQERKKERSRSIDKDRKKKDKEREREQDKRKEKQKREEKDFKFSSQDDRLKRKRESERTFSRSGSISVKIIRHDSRQDSKKSTTKDSKKHSGSDSSGRSSSESPGSSKEKKAKKPKHSRSRSVEKSQRSGKKASRKHKSKSRSR

SEQ ID NO: 853000 - protein, 805 aa, Homo sapiens; identical to SEQ ID NO: 852991

SEQ ID NO: 853001 - protein, 465 aa, Homo sapiens
MWDQGGQPWQQWPLNQQQWMQSFQHQQDPSQIDWAALAQAWIAQREASGQQSMVEQPPGMMPNGQDMSTMESGPNNHGNFQGDSNFNRMWQPEWGMHQQPPHPPPDQPWMPPTPGPMDIVPPSEDSNSQDSGEFAPDNRHIFNQNNHNFGGPPDNFAVGPVNQFDYQHGAAFGPPQGGFHPPYWQPGPPGPPAPPQNRRERPSSFRDRQRSPIALPVKQEPPQIDAVKRRTLPAWIREGLEKMEREKQKKLEKERMEQQRSQLSKKEKKATEDAEGGDGPRLPQRSKFDSDEEEEDTENVEAASSGKVTRSPSPVPQEEHSDPEMTEEEKEYQMMLLTKMLLTEILLDVTDEEIYYVAKDAHRKATKAPAKQLAQSSALASLTGLGGLGGYGSGDSEDERSDRGSESSDTDDEELRHRIRQKQEAFWRKEKEQQLLHDKQMEEEKQQTEREGETERDRQTGRERE

SEQ ID NO: 853002 - protein, 745 aa, Homo sapiens
MWDQGGQPWQQWPLNQQQWMQSFQHQQDPSQIDWAALAQAWIAQREASGQQSMVEQPPGMMPNGQDMSTMESGPNNHGNFQGDSNFNRMWQPEWGMHQQPPHPPPDQPWMPPTPGPMDIVPPYWQPGPPGPPAPPQNRRERPSSFRDRQRSPIALPVKQEPPQIDAVKRRTLPAWIREGLEKMEREKQKKLEKERMEQQRSQLSKKEKKATEDAEGGDGPRLPQRSKFDSDEEEEDTENVEAASSGKVTRSPSPVPQEEHSDPEMTEEEKEYQMMLLTKMLLTEILLDVTDEEIYYVAKDAHRKATKAPAKQLAQSSALASLTGLGGLGGYGSGDSEDERSDRGSESSDTDDEELRHRIRQKQEAFWRKEKEQQLLHDKQMEEEKQQTERVTKEMNEFIHKEQNSLSLLEAREADGDVVNEKKRTPNETTSVLEPKKEHKEKEKQGRSRSGSSSSGSSSSNSRTSSTSSTVSSSSYSSSSGSSRTSSRSSSPKRKKRHSRSRSPTIKARRSRSRSYSRRIKIESNRARVKIRDRRRSNRNSIERERRRNRSPSRERRRSRSRSRDRRTNRASRSRSRDRRKIDDQRGNLSGNSHKHKGEAKEQERKKERSRSIDKDRKKKDKEREREQDKRKEKQKREEKDFKFSSQDDRLKRKRESERTFSRSGSISVKIIRHDSRQDSKKSTTKDSKKHSGSDSSGRSSSESPGSSKEKKAKKPKHSRSRSVEKSQRSGKKASRKHKSKSRSR

SEQ ID NO: 853003 - protein, 563 aa, Homo sapiens; identical to SEQ ID NO: 852999

SEQ ID NO: 853004 - protein, 423 aa, Homo sapiens [sequence omitted]

SEQ ID NO: 853005 - protein, 487 aa, Homo sapiens
FAAASTEDDRREEYQMMLLTKMLLTEILLDVTDEEIYYVAKDAHRKATKAPAKQLAQSSALASLTGLGGLGGYGSGDSEDERSDRGSESSDTDDEELRHRIRQKQEAFWRKEKEQQLLHDKQMEEEKQQTERVTKEMNEFIHKEQNSLSLLEAREADGDVVNEKKRTPNETTSVLEPKKEHKEKEKQGRSRSGSSSSGSSSSNSRTSSTSSTVSSSSYSSSSGSSRTSSRSSSPKRKKRHSRSRSPTIKARRSRSRSYSRRIKIESNRARVKIRDRRRSNRNSIERERRRNRSPSRERRRSRSRSRDRRTNRASRSRSRDRRKIDDQRGNLSGNSHKHKGEAKEQERKKERSRSIDKDRKKKDKEREREQDKRKEKQKREEKDFKFSSQDDRLKRKRESERTFSRSGSISVKIIRHDSRQDSKKSTTKDSKKHSGSDSSGRSSSESPGSSKEKKAKKPKHSRSRSVEKSQRSGKKASRKHKSKSRSR

SEQ ID NO: 853006 - protein, 282 aa, Homo sapiens
MWDQGGQPWQQWPLNQQQWMQSFQHQQDPSQIDWAALAQAWIAQREASGQQSMVEQPPGMMPNGQDMSTMESGPNNHGNFQGDSNFNRMWQPEWGMHQQPPHPPPDQPWMPPTPGPMDIVPPSEDSNSQDSGEFAPDNRHIFNQNNHNFGGPPDNFAVGPVNQFDYQHGAAFGPPQGGFHPPYWQPGPPGPPAPPQNRRERPSSFRDRQRSPIALPVKQEPPQIDAVKRRTLPAWIREGLEKMEREKQKKLEVLEVLVANKEDEIHLAVDQKQPHAERVLQF

SEQ ID NO: 853007 - protein, 413 aa, Homo sapiens
MWDQGGQPWQQWPLNQQQWMQSFQHQQDPSQIDWAALAQAWIAQREASGQQSMVEQPPGMMPNGQDMSTMESGPNNHGNFQGDSNFNRMWQPEWGMHQQPPHPPPDQPWMPPTPGPMDIVPPSEDSNSQDSGEFAPDNRHIFNQNNHNFGGPPDNFAVGPVNQFDYQHGAAFGPPQGGFHPPYWQPGPPGPPAPPQNRRERPSSFRDRQRSPIALPVKQEPPQIDAVKRRTLPAWIREGLEKMEREKQKKLEKERMEQQRSQLSKKEKKATEDAEGGDGPRLPQRSKFDSDEEEEDTENVEAASSGKVTRSPSPVPQEEHSDPEMTEEEKEYQMMLLTKMLLTEILLDVTDEEIYYVAKDAHRKATKGIFWCFWFCFSWGILVLMTILAFFCCPCWISTRYLNILLHVLTLKD

SEQ ID NO: 853008 - protein, 787 aa, Homo sapiens
MWDQGGQPWQQWPLNQQQWMQSFQHQQDPSQIDWAALAQAWIAQREASGQQSMVEQPPGMMPNGQDMSTMESGPNNHGNFQGDSNFNRMWQPEWGMHQQPPHPPPDQPWMPPTPGPMDIVPPSEDSNSQDSGEFAPDNRHIFNQNNHNFGGPPDNFAVGPVNQFDYQHGAAFGPPQGGFHPPYWQPGPPGPPAPPQNRRERPSSFRDRQRSPIALPVKQEPPQIDAVKRRTLPAWIREGLEKMEREKQKKLEKERMEQQRSQLSKKEKKATEDAEGGDGPRLPQRSKFDSDEEEEDTENVEAASSGKVTRSPSPVPQEEHSDPEMTEEEKEYQMMLLTKMLLTEILLDVTDEEIYYVAKDAHRKATKGGLGGYGSGDSEDERSDRGSESSDTDDEELRHRIRQKQEAFWRKEKEQQLLHDKQMEEEKQQTERVTKEMNEFIHKEQNSLSLLEAREADGDVVNEKKRTPNETTSVLEPKKEHKEKEKQGRSRSGSSSSGSSSSNSRTSSTSSTVSSSSYSSSSGSSRTSSRSSSPKRKKRHSRSRSPTIKARRSRSRSYSRRIKIESNRARVKIRDRRRSNRNSIERERRRNRSPSRERRRSRSRSRDRRTNRASRSRSRDRRKIDDQRGNLSGNSHKHKGEAKEQERKKERSRSIDKDRKKKDKEREREQDKRKEKQKREEKDFKFSSQDDRLKRKRESERTFSRSGSISVKIIRHDSRQDSKKSTTKDSKKHSGSDSSGRSSSESPGSSKEKKAKKPKHSRSRSVEKSQRSGKKASRKHKSKSRSR

SEQ ID NO: 853009 - protein, 805 aa, Homo sapiens; identical to SEQ ID NO: 852991

SEQ ID NO: 853010 - protein, 805 aa, Homo sapiens; identical to SEQ ID NO: 852991

SEQ ID NO: 853011 - protein, 805 aa, Homo sapiens; identical to SEQ ID NO: 852991

SEQ ID NO: 853012 - protein, 174 aa, Homo sapiens
MWDQGGQPWQQWPLNQQQWMQSFQHQQDPSQIDWAALAQAWIAQREASGQQSMVEQPPGMMPNGQDMSTMESGPNNHGNFQGDSNFNRMWQPEWGMHQQPPHPPPDQPWMPPTPGPMDIVPPSEDSNSQDSGEFAPDNRHIFNQNNHNFGGPPDNFAVGPVNQFDYQVKDILLL

SEQ ID NO: 853013 - protein, 805 aa, Homo sapiens; identical to SEQ ID NO: 852991

SEQ ID NO: 853014 - protein, 465 aa, Homo sapiens; identical to SEQ ID NO: 853001

SEQ ID NO: 853015 - protein, 618 aa, Homo sapiens
MALKKGMIFNGIFFKFTHKFVEIFYLTDLRIFFPRETDAVKRRTLPAWIREGLEKMEREKQKKLEKERMEQQRSQLSKKEKKATEDAEGGDGPRLPQRSKFDSDEEEEDTENVEAASSGKVTRSPSPVPQEEHSDPEMTEEEKEYQMMLLTKMLLTEILLDVTDEEIYYVAKDAHRKATKAPAKQLAQSSALASLTGLGGLGGYGSGDSEDERSDRGSESSDTDDEELRHRIRQKQEAFWRKEKEQQLLHDKQMEEEKQQTERVTKEMNEFIHKEQNSLSLLEAREADGDVVNEKKRTPNETTSVLEPKKEHKEKEKQGRSRSGSSSSGSSSSNSRTSSTSSTVSSSSYSSSSGSSRTSSRSSSPKRKKRHSRSRSPTIKARRSRSRSYSRRIKIESNRARVKIRDRRRSNRNSIERERRRNRSPSRERRRSRSRSRDRRTNRASRSRSRDRRKIDDQRGNLSGNSHKHKGEAKEQERKKERSRSIDKDRKKKDKEREREQDKRKEKQKREEKDFKFSSQDDRLKRKRESERTFSRSGSISVKIIRHDSRQDSKKSTTKDSKKHSGSDSSGRSSSESPGSSKEKKAKKPKHSRSRSVEKSQRSGKKASRKHKSKSRSR

SEQ ID NO: 853016 - protein, 676 aa, Homo sapiens
GGGFGYFFKPTCSLGSAWKAGHTDRGRVVALRGSPDYQHGAAFGPPQGGFHPPYWQPGPPGPPAPPQNRRERPSSFRDRQRSPIALPVKQEPPQIDAVKRRTLPAWIREGLEKMEREKQKKLEKERMEQQRSQLSKKEKKATEDAEGGDGPRLPQRSKFDSDEEEEDTENVEAASSGKVTRSPSPVPQEEHSDPEMTEEEKEYQMMLLTKMLLTEILLDVTDEEIYYVAKDAHRKATKAPAKQLAQSSALASLTGLGGLGGYGSGDSEDERSDRGSESSDTDDEELRHRIRQKQEAFWRKEKEQQLLHDKQMEEEKQQTERVTKEMNEFIHKEQNSLSLLEAREADGDVVNEKKRTPNETTSVLEPKKEHKEKEKQGRSRSGSSSSGSSSSNSRTSSTSSTVSSSSYSSSSGSSRTSSRSSSPKRKKRHSRSRSPTIKARRSRSRSYSRRIKIESNRARVKIRDRRRSNRNSIERERRRNRSPSRERRRSRSRSRDRRTNRASRSRSRDRRKIDDQRGNLSGNSHKHKGEAKEQERKKERSRSIDKDRKKKDKEREREQDKRKEKQKREEKDFKFSSQDDRLKRKRESERTFSRSGSISVKIIRHDSRQDSKKSTTKDSKKHSGSDSSGRSSSESPGSSKEKKAKKPKHSRSRSVEKSQRSGKKASRKHKSKSRSR

SEQ ID NO: 853017 - protein, 376 aa, Homo sapiens [sequence omitted]

SEQ ID NO: 853018 - protein, 120 aa, Homo sapiens
MSRRFTVTSLPPAGPARSPDPESRRHSVADPRHLPGEDVKVSPQGALIRGPLPGSEALGSGRNKANRLVVAPARGGGGGGGGGGGRGGGGRGGGRGGGGEGGGEASPDRQGSLPSRSKSN

SEQ ID NO: 853019 - protein, 124 aa, Homo sapiens
VGGVFLAGPVQGLVMEVTRRAQSIGEGKDPSGLRWRSSILGACTVSPQGALIRGPLPGSEALGSGRNKANRLVVAPARGGGGGGGGGGGRGGGGRGGGRGGGGEGGGEASPDRQGSLPSRSKSN

SEQ ID NO: 853020 - protein, 535 aa, Homo sapiens
RDQFDLTVGITDPEASGGGGCSASERLPPPFPGLEPESEGAAGGSEPEAGDSDTEGEDIFTGAAVVSKHQSPKITTSLLPINNGSKENGIHEEQDQEPQDLFADATVELSLDSTQNNQKKVLAKTLISLPPQEATNSSKPQPTYEELEEEEQEDQFDLTVGITDPEKIGDGMNAYVAYKVTTQTSLPLFRSKQFAVKRRFSDFLGLYEKLSEKHSQNGFIVPPPPEKSLIGMTKVKVGKEDSSSAEFLEKRRAALERYLQRIVNHPTMLQDPDVREFLEKEELPRAVGTQTLSGAGLLKMFNKATDAVSKMTIKMNESDIWFEEKLQEVECEEQRLRKLHAVVETLVNHRKELALNTAQFAKSLAMLGSSEDNTALSRALSQLAEVEEKIEQLHQEQANNDFFLLAELLSDYIRLLAIVRAAFDQRMKTWQRWQDAQATLQKKREAEARLLWANKPDKLQQAKDEILEWESRVTQYERDFERISTVVRKEVIRFEKEKSKDFKNHVIKYLETLLYSQQQLAKYWEAFLPEAKAIS

SEQ ID NO: 853021 - protein, 479 aa, Homo sapiens
MASGGGGCSASERLPPPFPGLEPESEGAAGGSEPEAGDSDTEGEDIFTGAAVVSKHQSPKITTSLLPINNGSKENGIHEEQDQEPQDLFADATVELSLDSTQNNQKKVLAKTLISLPPQEATNSSKPQPTYEELEEEEQEDQFDLTVGITDPEKIGDGMNAYVAYKVTTQTSLPLFRSKQFAVKRRFSDFLGLYEKLSEKHSQNGFIVPPPPEKSLIGMTKVKVGKEDSSSAEFLEKRRAALERYLQRIVNHPTMLQDPDVREFLEKEELPRAVGTQTLSGAGLLKMFNKATDAVSKMTIKMNESDIWFEEKLQEVECEEQRLRKLHAVVETLVNHRKELALNTAQFAKSLAMLGSSEDNTALSRALSQLAEVEEKIEQLHQEQANNDFFLLAELLSDYIRLLAIVRAAFDQRMKTWQRWQDAQATLQKKREAEARLLWANKPDKLQQAKDEILEWESYSQQQLAKYWEAFLPEAKAIS

SEQ ID NO: 853022 - protein, 536 aa, Homo sapiens
MASGGGGCSASERLPPPFPGLEPESEGAAGGSEPEAGDSDTEGEDIFTGAAVVSKHQSPKITTSLLPINNGSKENGIHEEQDQEPQDLFADATVELSLDSTQNNQKKVLAKTLISLPPQEATNSSKPQPTYEELEEEEQEDQFDLTVGITDPEKIGDGMNAYVAYKVTTQTSLPLFRSKQFAVKRRFSDFLGLYEKLSEKHSQNGFIVPPPPEKSLIGMTKVKVGKEDSSSAEFLEKRRAALERYLQRIVNHPTMLQDPDVREFLEKEEGQQITCHPCLLGLELPRAVGTQTLSGAGLLKMFNKATDAVSKMTIKMNESDIWFEEKLQEVECEEQRLRKLHAVVETLVNHRKELALNTAQFAKSLAMLGSSEDNTALSRALSQLAEVEEKIEQLHQEQANNDFFLLAELLSDYIRLLAIVRAAFDQRMKTWQRWQDAQATLQKKREAEARLLWANKPDKLQQAKDEILEWESRVTQYERDFERISTVVRKEVIRFEKEKSKDFKNHVIKYLETLLYSQQQLAKYWEAFLPEAKAIS

SEQ ID NO: 853023 - protein, 364 aa, Homo sapiens
MNAYVAYKVTTQTSLPLFRSKQFAVKRRFSDFLGLYEKLSEKHSQNGFIVPPPPEKSLIGMTKVKVGKEDSSSAEFLEKRRAALERYLQRIVNHPTMLQDPDVREFLEKEELPRAVGTQTLSGAGLLKMFNKATDAVSKMTIKMNESDIWFEEKLQEVECEEQRLRKLHAVVETLVNHRKELALNTAQFAKSLAMLGSSEDNTALSRALSQLAEVEEKIEQLHQEQANNDFFLLAELLSDYIRLLAIVRAAFDQRMKTWQRWQDAQATLQKKREAEARLLWANKPDKLQQAKDEILEWESRVTQYERDFERISTVVRKEVIRFEKEKSKDFKNHVIKYLETLLYSQQQLAKYWEAFLPEAKAIS

SEQ ID NO: 853024 - protein, 482 aa, Homo sapiens
SLFADDMIVYLEASKHQSPKITTSLLPINNGSKENGIHEEQDQEPQDLFADATVELSLDSTQNNQKKVLAKTLISLPPQEATNSSKPQPTYEELEEEEQEDQFDLTVGITDPEKIGDGMNAYVAYKVTTQTSLPLFRSKQFAVKRRFSDFLGLYEKLSEKHSQNGFIVPPPPEKSLIGMTKVKVGKEDSSSAEFLEKRRAALERYLQRIVNHPTMLQDPDVREFLEKEELPRAVGTQTLSGAGLLKMFNKATDAVSKMTIKMNESDIWFEEKLQEVECEEQRLRKLHAVVETLVNHRKELALNTAQFAKSLAMLGSSEDNTALSRALSQLAEVEEKIEQLHQEQANNDFFLLAELLSDYIRLLAIVRAAFDQRMKTWQRWQDAQATLQKKREAEARLLWANKPDKLQQAKDEILEWESRVTQYERDFERISTVVRKEVIRFEKEKSKDFKNHVIKYLETLLYSQQQLAKYWEAFLPEAKAIS

SEQ ID NO: 853025 - protein, 561 aa, Homo sapiens
MASGGGGCSASERLPPPFPGLEPESEGAAGGSEPEAGDSDTEGEDIFTGAAVVSKHQSPKITTSLLPINNGSKENGIHEEQDQEPQDLFAGSHSVAQAGVQWCGHGSLQPRPPRLSDLPTSTFWVARTTDATVELSLDSTQNNQKKVLAKTLISLPPQEATNSSKPQPTYEELEEEEQEDQFDLTVGITDPEKIGDGMNAYVAYKVTTQTSLPLFRSKQFAVKRRFSDFLGLYEKLSEKHSQNGFIVPPPPEKSLIGMTKVKVGKEDSSSAEFLEKRRAALERYLQRIVNHPTMLQDPDVREFLEKEELPRAVGTQTLSGAGLLKMFNKATDAVSKMTIKMNESDIWFEEKLQEVECEEQRLRKLHAVVETLVNHRKELALNTAQFAKSLAMLGSSEDNTALSRALSQLAEVEEKIEQLHQEQANNDFFLLAELLSDYIRLLAIVRAAFDQRMKTWQRWQDAQATLQKKREAEARLLWANKPDKLQQAKDEILEWESRVTQYERDFERISTVVRKEVIRFEKEKSKDFKNHVIKYLETLLYSQQQLAKYWEAFLPEAKAIS

SEQ ID NO: 853026 - protein, 364 aa, Homo sapiens; identical to SEQ ID NO: 853023

SEQ ID NO: 853027 - protein, 522 aa, Homo sapiens
MASGGGGCSASERLPPPFPGLEPESEGAAGGSEPEAGDSDTEGEDIFTGAAVVSKHQSPKITTSLLPINNGSKENGIHEEQDQEPQDLFADATVELSLDSTQNNQKKVLAKTLISLPPQEATNSSKPQPTYEELEEEEQEDQFDLTVGITDPEKIGDGMNAYVAYKVTTQTSLPLFRSKQFAVKRRFSDFLGLYEKLSEKHSQNGFIVPPPPEKSLIGMTKVKVGKEDSSSAEFLEKRRAALERYLQRIVNHPTMLQDPDVREFLEKEELPRAVGTQTLSGAGLLKMFNKATDAVSKMTIKMNESDIWFEEKLQEVECEEQRLRKLHAVVETLVNHRKELALNTAQFAKSLAMLGSSEDNTALSRALSQLAEVEEKIEQLHQEQANNDFFLLAELLSDYIRLLAIVRAAFDQRMKTWQRWQDAQATLQKKREAEARLLWANKPDKLQQAKDEILEWESRVTQYERDFERISTVVRKEVIRFEKEKSKDFKNHVIKYLETLLYSQQQLAKYWEAFLPEAKAIS

SEQ ID NO: 853028 - protein, 142 aa, Homo sapiens
GCTGPEGLTTSGGGGCSASERLPPPFPGLEPESEGAAGGSEPEAGDSDTEGEDIFTGAAVVSKHQSPKITTSLLPINNGSKENGIHEEQDQEPQDLFADATVELSLDSTQNNQKKVLARDYRREPPHPALSCFLKDLKASTQ

SEQ ID NO: 853029 - protein, 342 aa, Homo sapiens [sequence omitted]

SEQ ID NO: 853030 - protein, 457 aa, Homo sapiens
MASGGGGCSASERLPPPFPGLEPESEGAAGGSEPEAGDSDTEGEDIFTGAAVVSKHQSPKITTSLLPINNGSKENGIHEEQDQEPQDLFAGDGMNAYVAYKVTTQTSLPLFRSKQFAVKRRFSDFLGLYEKLSEKHSQNGFIVPPPPEKSLIGMTKVKVGKEDSSSAEFLEKRRAALERYLQRIVNHPTMLQDPDVREFLEKEELPRAVGTQTLSGAGLLKMFNKATDAVSKMTIKMNESDIWFEEKLQEVECEEQRLRKLHAVVETLVNHRKELALNTAQFAKSLAMLGSSEDNTALSRALSQLAEVEEKIEQLHQEQANNDFFLLAELLSDYIRLLAIVRAAFDQRMKTWQRWQDAQATLQKKREAEARLLWANKPDKLQQAKDEILEWESRVTQYERDFERISTVVRKEVIRFEKEKSKDFKNHVIKYLETLLYSQQQLAKYWEAFLPEAKAIS

SEQ ID NO: 853031 - protein, 364 aa, Homo sapiens; identical to SEQ ID NO: 853023

SEQ ID NO: 853032 - protein, 170 aa, Homo sapiens [sequence omitted]

SEQ ID NO: 853033 - protein, 159 aa, Homo sapiens
MDIVPSANMDPYKGARPAPVHLQAPQELLGLLPHVVVQGELLEDLLAEVVVEGPGAGVAGEADVLPRDVAVFLLHPVVQVVVLPGDPAGRGAVQHRQGDSEDGGQGAVHLGRDEGGPPVHLGQGVQRGVLAHLVPQAALGVDSEQVLPGQVSGGQDHTG

SEQ ID NO: 853034 - protein, 71 aa, Homo sapiens
TPPPPHEDLQVVQPTAESGRPDSPLLLASCGSAQCFSTWYILVPRSQTSDGRAQRGAAHAPCTPPAPSILY

SEQ ID NO: 853035 - protein, 328 aa, Homo sapiens
MGAAARLSAPRALVLWAALGAAAHIGPAPDPEDWWSYKDNLQGNFVPGPPFWGLVNAAWSLCAVGKRQSPVDVELKRVLYDPFLPPLRLSTGGEKLRGTLYNTGRHVSFLPAPRPVVNVSGGPLLYSHRLSELRLLFGARDGAGSEHQINHQGFSAEVQLIHFNQELYGNFSAASRGPNGLAILSLFVNVASTSNPFLSRLLNRDTITRISYKNDAYFLQDLSLELLFPESFGFITYQGSLSTPPCSETVTWILIDRALNITSLQMHSLRLLSQNPPSQIFQSLSGNSRPLQPLAHRALRGNRDPRHPERRCRGPNYRLHVDGVPHGR

SEQ ID NO: 853036 - protein, 328 aa, Homo sapiens; identical to SEQ ID NO: 853035

SEQ ID NO: 853037 - protein, 346 aa, Homo sapiens
MGAAARLSAPRALVLWAALGAAAHIGPAPDPEDWWSYKDNLQGNFVPGPPFWGLVNAAWSLCAVGKRQSPVDVELKRVLYDPFLPPLRLSTGGEKLRGTLYNTGRHVSFLPAPRPVVNVSGGPLLYSHRLSELRLLFGARDGAGSEHQINHQGFSAEVQLIHFNQELYGNFSAASRGPNGLAILSLFVNVASTSNPFLSRLLNRDTITRISYKNDAYFLQDLSLELLFPESFGFITYQGSLSTPPCSETVTWILIDRALNITSLQMHSLRLLSQNPPSQIFQSLSGNSRPLQPLAHRALRGNRDPRHPERRCRGPNYRLHAQCFSTWYILVPRSQTSDVDGVPHGR

SEQ ID NO: 853038 - protein, 345 aa, Homo sapiens [sequence omitted]

SEQ ID NO: 853039 - protein, 361 aa, Homo sapiens
LANLVKPVSAKLGNYSKILLGPRILDLSPVLPQTQESRSLAPPPLGSGSPDHSPLSRYQPWDPVSISDSLSSYSDPSPQGRPPFWGLVNAAWSLCAVGKRQSPVDVELKRVLYDPFLPPLRLSTGGEKLRGTLYNTGRHVSFLPAPRPVVNVSGGPLLYSHRLSELRLLFGARDGAGSEHQINHQGFSAEVQLIHFNQELYGNFSAASRGPNGLAILSLFVNVASTSNPFLSRLLNRDTITRISYKNDAYFLQDLSLELLFPESFGFITYQGSLSTPPCSETVTWILIDRALNITSLQMHSLRLLSQNPPSQIFQSLSGNSRPLQPLAHRALRGNRDPRHPERRCRGPNYRLHVDGVPHGR

SEQ ID NO: 853040 - protein, 280 aa, Homo sapiens
MGAAARLSAPRALVLWAALGAAAHIGPAPDPEDWWSYKDNLQGNFVPGPPFWGLVNAAWSLCAVGKRQSPVDVELKRVLYDPFLPPLRLSTGGEKLRGTLYNTGRHVSFLPAPRPVVNVSGGPLLYSHRLSELRLLFGARDGAGSEHQINHQGFSAEVQLIHFNQELYGNFSAASRGPNGLAILSLFVNVASTSNPFLSRLLNRDTITRISYKNDAYFLQDLSLELLFPESFGFITYQGSLSTPPCSETVTWILIDRALNITSLQMHSLSSEPGGILRAT

SEQ ID NO: 853041 - protein, 306 aa, Homo sapiens
MRTRHMQGWLEAVLSSLSKVSRKAHPLWQEGRLRPKDHVERGVGQGEVGQVDSVPAREVRGPDPEGAHGDDGVVALCEQCEVLGRGALEAIASEHHVPKGAVDALPAPGHVIAGDHKDREAAAGPEPVQGPLQVAGRPAPPSIRAHDTDIVPPAHVDPHEGRLPCPLGLQAPQELLGLLAHVVVQGELLEDLLAEVVVEGPGAGVAREADTAPRDVAVLLLHPVVQVVVLPGDPAGRGAVQHRQGDSEDGGQGAVHLGRDEGGPPVHLGQGVQRGVLAHLVPQAALGVDSEQVLPGQVSGGQDHTG

SEQ ID NO: 853042 - protein, 306 aa, Homo sapiens; identical to SEQ ID NO: 853041

SEQ ID NO: 853043 - protein, 306 aa, Homo sapiens; identical to SEQ ID NO: 853041

SEQ ID NO: 853044 - protein, 91 aa, Homo sapiens
APRGGVSCVTSPRPFTIHSQFPTLLPLQMHSLRLLSQNPPSQIFQSLSGNSRPLQPLAHRALRGNRDPRHPERRCRGPNYRLHVDGVPHGR

SEQ ID NO: 853045 - protein, 108 aa, Homo sapiens
APRGGVSCVTSPRPFTIHSQFPTLLPLQMHSLRLLSQNPPSQIFQSLSGNSRPLQPLAHRALRGNRDPRHPERRCRGPNYRLHGMVQSAPPLSLGLTLLYVSPLGVSV

SEQ ID NO: 853046 - protein, 328 aa, Homo sapiens; identical to SEQ ID NO: 853035

SEQ ID NO: 853047 - protein, 346 aa, Homo sapiens; identical to SEQ ID NO: 853037

SEQ ID NO: 853048 - protein, 328 aa, Homo sapiens; identical to SEQ ID NO: 853035

SEQ ID NO: 853049 - protein, 298 aa, Homo sapiens
RLKQGEEAGEEEVGEHEGPPFWGLVNAAWSLCAVGKRQSPVDVELKRVLYDPFLPPLRLSTGGEKLRGTLYNTGRHVSFLPAPRPVVNVSGGPLLYSHRLSELRLLFGARDGAGSEHQINHQGFSAEVQLIHFNQELYGNFSAASRGPNGLAILSLFVNVASTSNPFLSRLLNRDTITRISYKNDAYFLQDLSLELLFPESFGFITYQGSLSTPPCSETVTWILIDRALNITSLQMHSLRLLSQNPPSQIFQSLSGNSRPLQPLAHRALRGNRDPRHPERRCRGPNYRLHVDGVPHGR

SEQ ID NO: 853050 - protein, 211 aa, Homo sapiens
MGAAARLSAPRALVLWAALGAAAHIGPAPDPEDWWSYKDNLQGNFVPGPPFWGLVNAAWSLCAVGKRQSPVDVELKRVLYDPFLPPLRLSTGGEKLRGTLYNTGRHVSFLPAPRPVVNVSGGPLLYSHRLSELRLLFGARDGAGSEHQINHQGFSAEVQLIHFNQELYGNFSAASRGPNGLAILSLFVNVCQYLYPFLSRILNAQLKTTVT

SEQ ID NO: 853051 - protein, 306 aa, Homo sapiens; identical to SEQ ID NO: 853041

SEQ ID NO: 853052 - protein, 143 aa, Homo sapiens
APSVTSAIRNERLRNERPERAPSVTSPISVVVVVVEGPGAGVAREADTAPRDVAVLLLHPVVQVVVLPGDPAGRGAVQHRQGDSEDGGQGAVHLGRDEGGPPVHLGQGVQRGVLAHLVPQAALGVDSEQVLPGQVSGGQDHTG

SEQ ID NO: 853053 - protein, 527 aa, Homo sapiens
LTYEEVLKRNHMQYEIVIKVKPKQLVHHFEIDVDIFEPQGISKLDAQASFLPKELAAQTIKKSFSGKKGHVLFRPTVSQQQSCPTCSTSLLNGHFKVTYDVSRDKICDLLVANNHFAHFFAPQNLTNMNKNVVFVIDISGSMRGQKVKQTKEALLKILGDMQPGDYFDLVLFGTRVQSWKGSLVQASEANLQAAQDFVRGFSLDEATNLNGGLLRGIEILNQVQESLPELSNHASILIMLTDGDPTEGVTDRSQILKNVRNAIRGRFPLYNLGFGHNVDFNFLEVMSMENNGRAQRIYEDHDATQQLQGFYSQVAKPLLVDVDLQYPQDAVLALTQNHHKQYYEGSEIVVAGRIADNKQSSFKADVQAHGEGQEFSITCLVDEEEMKKLLRERGHMLENHVERLWAYLTIQELLAKRMKVDREERANLSSQALRMSLDYGFVTPLTSMSIRGMADQDGLKPTIDKPSEDSPPLEMLGPRRTFVLSALQPSPTHSSSNTQRLPDRVDRRGTQTLQFHSFHVPVRDNLL

SEQ ID NO: 853054 - protein, 1849 aa, Homo sapiens
MYEGKKTKNMFLTRALEKILADKEVKKAHHSQLRKACEVALEEIKAETEKQSPPHGEAKAGSSTLPPVKSKTNFIEADKYFLPFELACQSKCPRIVSTSLDCLQKLIAYGHLTGNAPDSTTPGKKLIDRIIETICGCFQGPQTDEGVQLQIIKALLTAVTSQHIEIHEGTVLQAVRTCYNIYLASKNLINQTTAKATLTQMLNVIFARMENQALQEAKQMEKERHRQHHHLLQSPVSHHEPESPQLRYLPPQTVDHISQEHEGDLDLHTNDVDKSLQDDTEPENGSDISSAENEQTEADQATAAETLSKNEVLYDGENHDCEEKPQDIVQNIVEEMVNIVVGDMGEGTTINASADGNIGTIEDGSDSENIQANGIPGTPISVAYTPSLPDDRLSVSSNDTQESGNSSGPSPGAKFSHILQKDAFLVFRSLCKLSMKPLSDGPPDPKSHELRSKILSLQLLLSILQNAGPIFRTNEMFINAIKQYLCVALSKNGVSSVPEVFELSLSIFLTLLSNFKTHLKMQIEVFFKEIFLYILETSTSSFDHKWMVIQTLTRICADAQSVVDIYVNYDCDLNAANIFERLVNDLSKIAQGRGSQELGMSNVQELSLRKKGLECLVSILKCMVEWSKDQYVNPNSQTTLGQEKPSEQEMSEIKHPETINRYGSLNSLESTSSSGIGSYSTQMSGTDNPEQFEVLKQQKEIIEQGIDLFNKKPKRGIQYLQEQGMLGTTPEDIAQFLHQEERLDSTQVGEFLGDNDKFNKEVMYAYVDQHDFSGKDFVSALRMFLEGFRLPGEAQKIDRLMEKFAARYLECNQGQTLFASADTAYVLAYSIIMLTTDLHSPQVKNKMTKEQYIKMNRGINDSKDLPEEYLSAIYNEIAGKKISMKETKELTIPTKSSKQNVASEKQRRLLYNLEMEQMAKTAKALMEAVSHVQAPFTSATHLEHVRPMFKLAWTPFLAAFSVGLQDCDDTEVASLCLEGIRCAIRIACIFSIQLERDAYVQALARFTLLTVSSGITEMKQKNIDTIKTLITVAHTDGNYLGNSWHEILKCISQLELAQLIGTGVKPRYISGTVRGREGSLTGTKDQAPDEFVGLGLVGGNVDWKQIASIQESIGETSSQSVVVAVDRIFTGSTRLDGNAIVDFVRWLCAVSMDELLSTTHPRMFSLQKIVEISYYNMGRIRLQWSRIWEVIGDHFNKVGCNPNEDVAIFAVDSLRQLSMKFLEKGELANFRFQKDFLRPFEHIMKRNRSPTIRDMVVRCIAQMVNSQAANIRSGWKNIFSVFHLAASDQDESIVELAFQTTGHIVTLVFEKHFPATIDSFQDAVKCLSEFACNAAFPDTSMEAIRLIRHCAKYVSDRPQAFKEYTSDDMNVAPEDRVWVRGWFPILFELSCIINRCKLDVRTRGLTVMFEIMKTYGHTYEKHWWQDLFRIVFRIFDNMKLPEQQTEKAEWMTTTCNHALYAICDVFTQYLEVLSDVLLDDIFAQLYWCVQQDNEQLARSGTNCLENVVILNGEKFTLEIWDKTCNCTLDIFKTTIPHALLTWRPNSGETAPPPPSPVSEKPLDTISQKSVDIHDSIQPRSVDNRPQAPLVSASAVNEEVSKIKSTAKFPEQKLFAALLIKCVVQLELIQTIDNIVFFPATSKKEDAENLAAAQRDAVDFDVRVDTQDQGMYRFLTSQQLFKLLDCLLESHRFAKAFNSNNEQRTALWKAGFKGKSKPNLLKQETSSLACGLRILFRMYMDESRVSAWEEVQQRLLNVCSEALSYFLTLTSESHREAWTNLLLLFLTKVLKISDNRFKAHASFYYPLLCEIMQFDLIPELRAVLRRFFLRIGVVFQISQPPEQELGINKQ

SEQ ID NO: 853055 - protein, 1849 aa, Homo sapiens; identical to SEQ ID NO: 853054

SEQ ID NO: 853056 - protein, 1849 aa, Homo sapiens; identical to SEQ ID NO: 853054

SEQ ID NO: 853057 - protein, 1347 aa, Homo sapiens
MYEGKKTKNMFLTRALEKILADKEVKKAHHSQLRKACEVALEEIKAETEKQSPPHGEAKAGSSTLPPVKSKTNFIEADKYFLPFELACQSKCPRIVSTSLDCLQKLIAYGHLTGNAPDSTTPGKKLIDRIIETICGCFQGPQTDEGVQLQIIKALLTAVTSQHIEIHEGTVLQAVRTCYNIYLASKNLINQTTAKATLTQMLNVIFARMENQALQEAKQMEKERHRQHHHLLQSPVSHHEPESPQLRYLPPQTVDHISQEHEGDLDLHTNDVDKSLQDDTEPENGSDISSAENEQTEADQATAAETLSKNEVLYDGENHDCEEKPQDIVQNIVEEMVNIVVGDMGEGTTINASADGNIGTIEDGSDSENIQANGIPGTPISVAYTPSLPDDRLSVSSNDTQESGNSSGPSPGAKFSHILQKDAFLVFRSLCKLSMKPLSDGPPDPKSHELRSKILSLQLLLSILQNAGPIFRTNEMFINAIKQYLCVALSKNGVSSVPEVFELSLSIFLTLLSNFKTHLKMQIEVFFKEIFLYILETSTSSFDHKWMVIQTLTRICADAQSVVDIYVNYDCDLNAANIFERLVNDLSKIAQGRGSQELGMSNVQELSLRKKGLECLVSILKCMVEWSKDQYVNPNSQTTLGQEKPSEQEMSEIKHPETINRYGSLNSLESTSSSGIGSYSTQMSGTDNPEQFEVLKQQKEIIEQGIDLFNKKPKRGIQYLQEQGMLGTTPEDIAQFLHQEERLDSTQVGEFLGDNDKFNKEVMYAYVDQHDFSGKDFVSALRMFLEGFRLPGEAQKIDRLMEKFAARYLECNQGQTLFASADTAYVLAYSIIMLTTDLHSPQVKNKMTKEQYIKMNRGINDSKDLPEEYLSAIYNEIAGKKISMKETKELTIPTKSSKQNVASEKQRRLLYNLEMEQMAKTAKALMEAVSHVQAPFTSATHLEHVRPMFKLAWTPFLAAFSVGLQDCDDTEVASLCLEGIRCAIRIACIFSIQLERDAYVQALARFTLLTVSSGITEMKQKNIDTIKTLITVAHTDGNYLGNSWHEILKCISQLELAQLIGTGVKPRYISGTVRGREGSLTGTKDQAPDEFVGLGLVGGNVDWKQIASIQESIGETSSQSVVVAVDRIFTGSTRLDGNAIVDFVRWLCAVSMDELLSTTHPRMFSLQKIVEISYYNMGRIRLQWSRIWEVIGDHFNKVGCNPNEDVAIFAVDSLRQLSMKFLEKGELANFRFQKDFLRPFEHIMKRNRSPTIRDMVVRCIAQMVNSQAANIRSGWKNIFSVFHLAASDQDESIVELAFQTTGHIVTLVFEKHFPATIDSFQDAVKCLSEFACNAAFPDTSFQGIHKR

SEQ ID NO: 853058 - protein, 252 aa, Homo sapiens [sequence omitted]

SEQ ID NO: 853059 - protein, 267 aa, Homo sapiens
YYLHLLYVKMSLDTISQKSVDIHDSIQPRSVDNRPQAPLVSASAVNEEVSKIKSTATTSKKEDAENLAAAQRDAVDFDVRVDTQDQGMYRFLTSQQLFKLLDCLLESHRFAKAFNSNNEQRTALWKAGFKGKSKPNLLKQETSSLACGLRILFRMYMDESRVSAWEEVQQRLLNVCSEALSYFLTLTSESHREAWTNLLLLFLTKVLKISDNRFKAHASFYYPLLCEIMQFDLIPELRAVLRRFFLRIGVVFQISQPPEQELGINKQ

SEQ ID NO: 853060 - protein, 180 aa, Homo sapiens
MYRFLTSQQLFKLLDCLLESHRFAKAFNSNNEQRTALWKAGFKGKSKPNLLKQETSSLACGLRILFRMYMDESRVSAWEEVQQRLLNVCSEALSYFLTLTSESHREAWTNLLLLFLTKVLKISDNRFKAHASFYYPLLCEIMQFDLIPELRAVLRRFFLRIGVVFQISQPPEQELGINKQ

SEQ ID NO: 853061 - protein, 1800 aa, Homo sapiens
MYEGKKTKNMFLTRALEKILADKEVKKAHHSQLRKACEVALEEIKAETEKQSPPHGEAKAGSSTLPPVKSKTNFIEADKYFLPFELACQSKCPRIVSTSLDCLQKLIAYGHLTGNAPDSTTPGKKLIDRIIETICGCFQGPQTDEGVQLQIIKALLTAVTSQHIEIHEGTVLQAVRTCYNIYLASKNLINQTTAKATLTQMLNVIFARMENQALQEAKQMEKERHRQHHHLLQSPVSHHEPESPQLRYLPPQTVDHISQEHEGDLDLHTNDVDKSLQDDTEPENGSDISSAENEQTEADQATAAETLSKNEVLYDGENHDCEEKPQDIVQNIVEEMVNIVVGDMGEGTTINASADGNIGTIEDGSDSENIQANGIPGTPISVAYTPSLPDDRLSVSSNDTQESGNSSGPSPGAKFSHILQKDAFLVFRSLCKLSMKPLSDGPPDPKSHELRSKILSLQLLLSILQNAGPIFRTNEMFINAIKQYLCVALSKNGVSSVPEVFELSLSIFLTLLSNFKTHLKMQIEVFFKEIFLYILETSTSSFDHKWMVIQTLTRICADAQSVVDIYVNYDCDLNAANIFERLVNDLSKIAQGRGSQELGMSNVQELSLRKKGLECLVSILKCMVEWSKDQYVNPNSQTTLGQEKPSEQEMSEIKHPETINRYGSLNSLESTSSSGIGSYSTQMSGTDNPEQFEVLKQQKEIIEQGIDLFNKKPKRGIQYLQEQGMLGTTPEDIAQFLHQEERLDSTQVGEFLGDNDKFNKEVMYAYVDQHDFSGKDFVSALRMFLEGFRLPGEAQKIDRLMEKFAARYLECNQGQTLFASADTAYVLAYSIIMLTTDLHSPQVKNKMTKEQYIKMNRGINDSKDLPEEYLSAIYNEIAGKKISMKETKELTIPTKSSKQNVASEKQRRLLYNLEMEQMAKTAKALMEAVSHVQAPFTSATHLEHVRPMFKLAWTPFLAAFSVGLQDCDDTEVASLCLEGIRCAIRIACIFSIQLERDAYVQALARFTLLTVSSGITEMKQKNIDTIKTLITVAHTDGNYLGNSWHEILKCISQLELAQLIGTGVKPRYISGTVRGREGSLTGTKDQAPDEFVGLGLVGGNVDWKQIASIQESIGETSSQSVVVAVDRIFTGSTRLDGNAIVDFVRWLCAVSMDELLSTTHPRMFSLQKIVEISYYNMGRIRLQWSRIWEVIGDHFNKVGCNPNEDVAIFAVDSLRQLSMKFLEKGELANFRFQKDFLRPFEHIMKRNRSPTIRDMVVRCIAQMVNSQAANIRSGWKNIFSVFHLAASDQDESIVELAFQTTGHIVTLVFEKHFPATIDSFQDAVKCLSEFACNAAFPDTSMEAIRLIRHCAKYVSDRPQAFKEYTSDDMNVAPEDRVWVRGWFPILFELSCIINRCKLDVRTRGLTVMFEIMKTYGHTYEKHWWQDLFRIVFRIFDNMKLPEQQTEKAEWMTTTCNHALYAICDVFTQYLEVLSDVLLDDIFAQLYWCVQQDNEQLARSGTNCLENVVILNGEKFTLEIWDKTCNCTLDIFKTTIPHALLTWRPNSGETAPPPPSPVSEKPLDTISQKSVDIHDSIQPRSVDNRPQAPLVSASAVNEEVSKIKSTAKFPEQKLFAALLIKCVVQLELIQTIDNIVFFPATSKKEDAENLAAAQRDAVDFDVRVDTQDQGMYRFLTSQQLFKLLDCLLESHRFAKAFNSNNEQRTALWKAGFKGKSKPNLLKQETSSLACGLRILFRMYMDESRVSAWEEVQQRLLNVCSEALSYFLTLTSESHREAWTNLLLLFLTKVLKISDNRTKRTL

SEQ ID NO: 853062 - protein, 1851 aa, Homo sapiens
MYEGKKTKNMFLTRALEKILADKEVKKAHHSQLRKACEVALEEIKAETEKQSPPHGEAKAGSSTLPPVKSKTNFIEADKYFLPFELACQSKCPRIVSTSLDCLQKLIAYGHLTGNAPDSTTPGKKLIDRIIETICGCFQGPQTDEGVQLQIIKALLTAVTSQHIEIHEGTVLQAVRTCYNIYLASKNLINQTTAKATLTQMLNVIFARMENQALQEAKQMEKERHRQHHHLLQSPVSHHEPESPQLRYLPPQTVDHISQEHEGDLDLHTNDVDKSLQDDTEPENGSDISSAENEQTEADQATAAETLSKNEVLYDGENHDCEEKPQDIVQNIVEEMVNIVVGDMGEGTTINASADGNIGTIEDGSDSENIQANGIPGTPISVAYTPSLPDDRLSVSSNDTQESGNSSGPSPGAKFSHILQKDAFLVFRSLCKLSMKPLSDGPPDPKSHELRSKILSLQLLLSILQNAGPIFRTNEMFINAIKQYLCVALSKNGVSSVPEVFELSLSIFLTLLSNFKTHLKMQIEVFFKEIFLYILETSTSSFDHKWMVIQTLTRICADAQSVVDIYVNYDCDLNAANIFERLVNDLSKIAQGRGSQELGMSNVQELSLRKKGLECLVSILKCMVEWSKDQYVNPNSQTTLGQEKPSEQEMSEIKHPETINRYGSLNSLESTSSSGIGSYSTQMSGTDNPEQFEVLKQQKEIIEQGIDLFNKKPKRGIQYLQEQGMLGTTPEDIAQFLHQEERLDSTQVGEFLGDNDKFNKEVMYAYVDQHDFSGKDFVSALRMFLEGFRLPGEAQKIDRLMEKFAARYLECNQGQTLFASADTAYVLAYSIIMLTTDLHSPQVKNKMTKEQYIKMNRGINDSKDLPEEYLSAIYNEIAGKKISMKETKELTIPTKSSKQNVASEKQRRLLYNLEMEQMAKTAKALMEAVSHVQAPFTSATHLEHVRPMFKLAWTPFLAAFSVGLQDCDDTEVASLCLEGIRCAIRIACIFSIQLERDAYVQALARFTLLTVSSGITEMKQKNIDTIKTLITVAHTDGNYLGNSWHEILKCISQLELAQLIGTGVKPRYISGTVRGREGSLTGTKDQAPDEFVGLGLVGGNVDWKQIASIQESIGETSSQSVVVAVDRIFTGSTRLDGNAIVDFVRWLCAVSMDELLSTTHPRMFSLQKIVEISYYNMGRIRLQWSRIWEVIGDHFNKVGCNPNEDVAIFAVDSLRQLSMKFLEKGELANFRFQKDFLRPFEHIMKRNRSPTIRDMVVRCIAQMVNSQAANIRSGWKNIFSVFHLAASDQDESIVELAFQTTGHIVTLVFEKHFPATIDSFQDAVKCLSEFACNAAFPDTSMEAIRLIRHCAKYVSDRPQAFKEYTSDDMNVAPEDRVWVRGWFPILFELSCIINRCKLDVRTRGLTVMFEIMKTYGHTYEKHWWQDLFRIVFRIFDNMKLPEQQTEKAEWMTTTCNHALYAICDVFTQYLEVLSDVLLDDIFAQLYWCVQQDNEQLARSGTNCLENVVILNGEKFTLEIWDKTCNCTLDIFKTTIPHALLTWRPNSGETAPPPPSPVSEKPLDTISQKSVDIHDSIQPRSVDNRPQAPLVSASAVNEEVSKIKSTAKFPEQKLFAALLIKCVVQLELIQTIDNIVFFPATSKKEDAENLAAAQRDAVDFDVRVDTQDQGMYRFLTSQQLFKLLDCLLESHRFAKAFNSNNEQRTALWKAGFKGKSKPNLLKQETSSLACGLRILFRMYMDESRVSAWEEVQQRLLNVCSEALSYFLTLTSESHREAWTNLLLLFLTKVLKISDNRFADLLSFFTEFKKFSTGIYLKYWVQASFFVSLLLLFFEYHHMIMLISGWDPLERRR

SEQ ID NO: 853063 - protein, 317 aa, Homo sapiens
MYEGKKTKNMFLTRALEKILADKEVKKAHHSQLRKACEVALEEIKAETEKQSPPHGEAKAGSSTLPPVKSKTNFIEADKYFLPFELACQSKCPRIVSTSLDCLQKLIAYGHLTGNAPDSTTPGKKLIDRIIETICGCFQGPQTDEGVQLQIIKALLTAVTSQHIEIHEGTVLQAVRTCYNIYLASKNLINQTTAKATLTQMLNVIFARMENQALQEAKQMEKERHRQHHHLLQSPVSHHEPESPQLRYLPPQTVDHISQEHEGDLDLHTNDVDKSLQDDTEPENGSDISSAENEQTEADQATAAESNLLEKGVWGVC

SEQ ID NO: 853064 - protein, 406 aa, Homo sapiens
MYEGKKTKNMFLTRALEKILADKEVKKAHHSQLRKACEVALEEIKAETEKQSPPHGEAKAGSSTLPPVKSKTNFIEADKYFLPFELACQSKCPRIVSTSLDCLQKLIAYGHLTGNAPDSTTPGKKLIDRIIETICGCFQGPQTDEGVQLQIIKALLTAVTSQHIEIHEGTVLQAVRTCYNIYLASKNLINQTTAKATLTQMLNVIFARMENQALQEAKQMEKERHRQHHHLLQSPVSHHEPESPQLRYLPPQTVDHISQEHEGDLDLHTNDVDKSLQDDTEPENGSDISSAENEQTEADQATAAETLSKNEVLYDGENHDCEEKPQDIVQNIVEEMVNIVVGDMGEGTTINASADGNIGTIEDGSDSENIPLIQSLIQSKTLTLFSSVKAERGEKAAGEKFEAIRG

SEQ ID NO: 853065 - protein, 1849 aa, Homo sapiens; identical to SEQ ID NO: 853054

SEQ ID NO: 853066 - protein, 1849 aa, Homo sapiens; identical to SEQ ID NO: 853054

SEQ ID NO: 853067 - protein, 1849 aa, Homo sapiens; identical to SEQ ID NO: 853054

SEQ ID NO: 853068 - protein, 1725 aa, Homo sapiens
MYEGKKTKNMFLTRALEKILADKEVKKAHHSQLRKACEVALEEIKAETEKQSPPHGEAKAGSSTLPPVKSKTNFIEADKYFLPFELACQSKCPRIVSTSLDCLQKLIAYGHLTGNAPDSTTPGKKLIDRIIETICGCFQGPQTDEGVQLQIIKALLTAVTSQHIEIHEGTVLQAVRTCYNIYLASKNLINQTTAKATLTQMLNVIFARMENQALQEAKQMEKERHRQHHHLLQSPVSHHEPESPQLRYLPPQTVDHISQEHEGDLDLHTNDVDKSLQDDTEPENGSDISSAENEQTEADQATAAETLSKNEVLYDGENHDCEEKPQDIVQNIVEEMVNIVVGDMGEGTTINASADGNIGTIEDGSDSENIQANGIPGTPISVAYTPSLPDDRLSVSSNDTQESGNSSGPSPGAKFSHILQKDAFLVFRSLCKLSMKPLSDGPPDPKSHELRSKILSLQLLLSILQNAGPIFRTNEMFINAIKQYLCVALSKNGVSSVPEVFELSLSIFLTLLSNFKTHLKMQIEVFFKEIFLYILETSTSSFDHKWMVIQTLTRICADAQSVVDIYVNYDCDLNAANIFERLVNDLSKIAQGRGSQELGMSNVQELSLRKKGLECLVSILKCMVEWSKDQYVNPNSQTTLGQEKPSEQEMSEIKHPETINRYGSLNSLESTSSSGIGSYSTQMSGTDNPEQFEVLKQQKEIIEQGIDLFNKKPKRGIQYLQEQGMLGTTPEDIAQFLHQEERLDSTQVGEFLGDNDKFNKEVMYAYVDQHDFSGKDFVSALRMFLEGFRLPGEAQKIDRLMEKFAARYLECNQGQTLFASADTAYVLAYSIIMLTTDLHSPQVKNKMTKEQYIKMNRGINDSKDLPEEYLSAIYNEIAGKKISMKETKELTIPTKSSKQNVASEKQRRLLYNLEMEQMAKTAKALMEAVSHVQAPFTSATHLEHVRPMFKLAWTPFLAAFSVGLQDCDDTEVASLCLEGIRCAIRIACIFSIQLERDAYVQALARFTLLTVSSGITEMKQKNIDTIKTLITVAHTDGNYLGNSWHEILKCISQLELAQLIGTGVKPRYISGTVRGREGSLTGTKDQAPDEFVGLGLVGGNVDWKQIASIQESIGETSSQSVVVAVDRIFTGSTRLDGNAIVDFVRWLCAVSMDELLSTTHPRMFSLQKIVEISYYNMGRIRLQWSRIWEVIGDHFNKVGCNPNEDVAIFAVDSLRQLSMKFLEKGELANFRFQKDFLRPFEHIMKRNRSPTIRDMVVRCIAQMVNSQAANIRSGWKNIFSVFHLAASDQDESIVELAFQTTGHIVTLVFEKHFPATIDSFQDAVKCLSEFACNAAFPDTSMEAIRLIRHCAKYVSDRPQAFKEYTSDDMNVAPEDRVWVRGWFPILFELSCIINRCKLDVRTRGLTVMFEIMKTYGHTYEKHWWQDLFRIVFRIFDNMKLPEQQTEKAEWMTTTCNHALYAICDVFTQYLEVLSDVLLDDIFAQLYWCVQQDNEQLARSGTNCLENVVILNGEKFTLEIWDKTCNCTLDIFKTTIPHALLTWRPNSGETAPPPPSPVSEKPLDTISQKSVDIHDSIQPRSVDNRPQAPLVSASAVNEEVSKIKSTAKFPEQKLFAALLIKCVVQLELIQTIDNIVFFPATSKKEDAENLAAAQRDAVDFDVRVDTQDQGMYRFLTSQQLFKLLDCLLESHRFAKAIQRQIQAQPSEAGDQQPGLWAAHSLPDVHG

SEQ ID NO: 853069 - protein, 1589 aa, Homo sapiens
MYEGKKTKNMFLTRALEKILADKEVKKAHHSQLRKACEVALEEIKAETEKQSPPHGEAKAGSSTLPPVKSKTNFIEADKYFLPFELACQSKCPRIVSTSLDCLQKLIAYGHLTGNAPDSTTPGKKLIDRIIETICGCFQGPQTDEGVQLQIIKALLTAVTSQHIEIHEGTVLQAVRTCYNIYLASKNLINQTTAKATLTQMLNVIFARMENQALQEAKQMEKERHRQHHHLLQSPVSHHEPESPQLRYLPPQTVDHISQEHEGDLDLHTNDVDKSLQDDTEPENGSDISSAENEQTEADQATAAETLSKNEVLYDGENHDCEEKPQDIVQNIVEEMVNIVVGDMGEGTTINASADGNIGTIEDGSDSENIQANGIPGTPISVAYTPSLPDDRLSVSSNDTQESGNSSGPSPGAKFSHILQKDAFLVFRSLCKLSMKPLSDGPPDPKSHELRSKILSLQLLLSILQNAGPIFRTNEMFINAIKQYLCVALSKNGVSSVPEVFELSLSIFLTLLSNFKTHLKMQIEVFFKEIFLYILETSTSSFDHKWMVIQTLTRICADAQSVVDIYVNYDCDLNAANIFERLVNDLSKIAQGRGSQELGMSNVQELSLRKKGLECLVSILKCMVEWSKDQYVNPNSQTTLGQEKPSEQEMSEIKHPETINRYGSLNSLESTSSSGIGSYSTQMSGTDNPEQFEVLKQQKEIIEQGIDLFNKKPKRGIQYLQEQGMLGTTPEDIAQFLHQEERLDSTQVGEFLGDNDKFNKEVMYAYVDQHDFSGKDFVSALRMFLEGFRLPGEAQKIDRLMEKFAARYLECNQGQTLFASADTAYVLAYSIIMLTTDLHSPQVKNKMTKEQYIKMNRGINDSKDLPEEYLSAIYNEIAGKKISMKETKELTIPTKSSKQNVASEKQRRLLYNLEMEQMAKTAKALMEAVSHVQAPFTSATHLEHVRPMFKLAWTPFLAAFSVGLQDCDDTEVASLCLEGIRCAIRIACIFSIQLERDAYVQALARFTLLTVSSGITEMKQKNIDTIKTLITVAHTDGNYLGNSWHEILKCISQLELAQLIGTGVKPRYISGTVRGREGSLTGTKDQAPDEFVGLGLVGGNVDWKQIASIQESIGETSSQSVVVAVDRIFTGSTRLDGNAIVDFVRWLCAVSMDELLSTTHPRMFSLQKIVEISYYNMGRIRLQWSRIWEVIGDHFNKVGCNPNEDVAIFAVDSLRQLSMKFLEKGELANFRFQKDFLRPFEHIMKRNRSPTIRDMVVRCIAQMVNSQAANIRSGWKNIFSVFHLAASDQDESIVELAFQTTGHIVTLVFEKHFPATIDSFQDAVKCLSEFACNAAFPDTSMEAIRLIRHCAKYVSDRPQAFKEYTSDDMNVAPEDRVWVRGWFPILFELSCIINRCKLDVRTRGLTVMFEIMKTYGHTYEKHWWQDLFRIVFRIFDNMKLPEQQTEKAEWMTTTCNHALYAICDVFTQYLEVLSDVLLDDIFAQLYWCVQQDNEQLARSGTNCLENVVILNGEKFTLEIWDKTCNCTLDIFKTTIPHALLTWRPNSGETAPPPPSPDTISQKSVDIHDSIQPRSVDNRPQAATGFCVCC

SEQ ID NO: 853070 - protein, 1623 aa, Homo sapiens
MYEGKKTKNMFLTRALEKILADKEVKKAHHSQLRKACEVALEEIKAETEKQSPPHGEAKAGSSTLPPVKSKTNFIEADKYFLPFELACQSKCPRIVSTSLDCLQKLIAYGHLTGNAPDSTTPGKKLIDRIIETICGCFQGPQTDEGVQLQIIKALLTAVTSQHIEIHEGTVLQAVRTCYNIYLASKNLINQTTAKATLTQMLNVIFARMENQALQEAKQMEKERHRQHHHLLQSPVSHHEPESPQLRYLPPQTVDHISQEHEGDLDLHTNDVDKSLQDDTEPENGSDISSAENEQTEADQATAAETLSKNEVLYDGENHDCEEKPQDIVQNIVEEMVNIVVGDMGEGTTINASADGNIGTIEDGSDSENIQANGIPGTPISVAYTPSLPDDRLSVSSNDTQESGNSSGPSPGAKFSHILQKDAFLVFRSLCKLSMKPLSDGPPDPKSHELRSKILSLQLLLSILQNAGPIFRTNEMFINAIKQYLCVALSKNGVSSVPEVFELSLSIFLTLLSNFKTHLKMQIEVFFKEIFLYILETSTSSFDHKWMVIQTLTRICADAQSVVDIYVNYDCDLNAANIFERLVNDLSKIAQGRGSQELGMSNVQELSLRKKGLECLVSILKCMVEWSKDQYVNPNSQTTLGQEKPSEQEMSEIKHPETINRYGSLNSLESTSSSGIGSYSTQMSGTDNPEQFEVLKQQKEIIEQGIDLFNKKPKRGIQYLQEQGMLGTTPEDIAQFLHQEERLDSTQVGEFLGDNDKFNKEVMYAYVDQHDFSGKDFVSALRMFLEGFRLPGEAQKIDRLMEKFAARYLECNQGQTLFASADTAYVLAYSIIMLTTDLHSPQVKNKMTKEQYIKMNRGINDSKDLPEEYLSAIYNEIAGKKISMKETKELTIPTKSSKQNVASEKQRRLLYNLEMEQMAKTAKALMEAVSHVQAPFTSATHLEHVRPMFKLAWTPFLAAFSVGLQDCDDTEVASLCLEGIRCAIRIACIFSIQLERDAYVQALARFTLLTVSSGITEMKQKNIDTIKTLITVAHTDGNYLGNSWHEILKCISQLELAQLIGTGVKPRYISGTVRGREGSLTGTKDQAPDEFVGLGLVGGNVDWKQIASIQESIGETSSQSVVVAVDRIFTGSTRLDGNAIVDFVRWLCAVSMDELLSTTHPRMFSLQKIVEISYYNMGRIRLQWSRIWEVIGDHFNKVGCNPNEDVAIFAVDSLRQLSMKFLEKGELANFRFQKDFLRPFEHIMKRNRSPTIRDMVVRCIAQMVNSQAANIRSGWKNIFSVFHLAASDQDESIVELAFQTTGHIVTLVFEKHFPATIDSFQDAVKCLSEFACNAAFPDTSMEAIRLIRHCAKYVSDRPQAFKEYTSDDMNVAPEDRVWVRGWFPILFELSCIINRCKLDVRTRGLTVMFEIMKTYGHTYEKHWWQDLFRIVFRIFDNMKLPEQQTEKAEWMTTTCNHALYAICDVFTQYLEVLSDVLLDDIFAQLYWCVQQDNEQLARSGTNCLENVVILNGEKFTLEIWDKTCNCTLDIFKTTIPHALLTWRPNSGETAPPPPSPVSEKPLDTISQKSVDIHDSIQPRSVDNRPQAPLVSASAVNEEVSKIKSTATGTHPDYRQHCLLPSHK

SEQ ID NO: 853071 - protein, 814 aa, Homo sapiens
MYEGKKTKNMFLTRALEKILADKEVKKAHHSQLRKACEVALEEIKAETEKQSPPHGEAKAGSSTLPPVKSKTNFIEADKYFLPFELACQSKCPRIVSTSLDCLQKLIAYGHLTGNAPDSTTPGKKLIDRIIETICGCFQGPQTDEGVQLQIIKALLTAVTSQHIEIHEGTVLQAVRTCYNIYLASKNLINQTTAKATLTQMLNVIFARMENQALQEAKQMEKERHRQHHHLLQSPVSHHEPESPQLRYLPPQTVDHISQEHEGDLDLHTNDVDKSLQDDTEPENGSDISSAENEQTEADQATAAETLSKNEVLYDGENHDCEEKPQDIVQNIVEEMVNIVVGDMGEGTTINASADGNIGTIEDGSDSENIQANGIPGTPISVAYTPSLPDDRLSVSSNDTQESGNSSGPSPGAKFSHILQKDAFLVFRSLCKLSMKPLSDGPPDPKSHELRSKILSLQLLLSILQNAGPIFRTNEMFINAIKQYLCVALSKNGVSSVPEVFELSLSIFLTLLSNFKTHLKMQIEVFFKEIFLYILETSTSSFDHKWMVIQTLTRICADAQSVVDIYVNYDCDLNAANIFERLVNDLSKIAQGRGSQELGMSNVQELSLRKKGLECLVSILKCMVEWSKDQYVNPNSQTTLGQEKPSEQEMSEIKHPETINRYGSLNSLESTSSSGIGSYSTQMSGTDNPEQFEVLKQQKEIIEQGIDLFNKKPKRGIQYLQEQGMLGTTPEDIAQFLHQEERLDSTQVGEFLGDNDKFNKEVMYAYVDQHDFSGKDFVSALRMFLEGFRLPGEAQKIDRLMEKFAARYLECNQG

SEQ ID NO: 853072 - protein, 186 aa, Homo sapiens
MRHTIVDILTMKSQEKANLGENMEKSCASKEEVKEVSIEDTGVDVDPEKLEMESKLHRNLLFQDCEKEQDNKTKDPTHDVKTPNTETRTSCLIKYNVSTTPYLQSVKKKVQFDGTNSAFKELKFLTPVRRSRRLQEKTSKLPDMLKDHYPCVSSLEQLTELGRETDAFVCRPNAALCRVYYEADTT

SEQ ID NO: 853073 - protein, 164 aa, Homo sapiens [sequence omitted]

SEQ ID NO: 853074 - protein, 494 aa, Homo sapiens [sequence omitted]

SEQ ID NO: 853075 - protein, 700 aa, Homo sapiens
MSTPAVPQDLQLPPSQRAQSAFKEQRRQKLKEHLLRRKTLFAYKQENEMLSSRDQRVVTSEDQVQEGTKVLKLKTKMADKENMKRPAESKNNTVVGKHCIPLKPSNELTNSTVVIDTHKPKDSNQTPHLLLTEDDPQSQHMTLSQAFHLKNNSKKKQMTTEKQKQDANMPKKPVLGSYRGQIVQSKINSFRKPLQVKDESSAATKKLSATIPKATKPQPVNTSSVTVKSNRSSNMTATTKFVSTTSQNTQLVRPPIRSHHSNTRDTVKQGISRTSANVTIRKGPHEKELLQSKTALSSVKTSSSQGIIRNKTLSRSIASEVVARPASLSNDKLMEKSEPVDQRRHTAGKAIVDSRSAQPKETSEERKARLSEWKAGKGRVLKRPPNSVVTQHEPAGQNEKPVGSFWTTMAEEDEQRLFTEKVNNTFSECLNLINEGCPKEDILVTLNDLIKNIPDAKKLVKYWICLALIEPITSPIENIIAIYEKAILAGAQPIEEMRHTIVDILTMKSQEKANLGENMEKSCASKEEVKEVSIEDTGVDVDPEKLEMESKLHRNLLFQDCEKEQDNKTKDPTHDVKTPNTETRTSCLIKYNVSTTPYLQSVKKKVQFDGTNSAFKELKFLTPVRRSRRLQEKTSKLPDMLKDHYPCVSSLEQLTELMLSPNTVVKQGLEPPSFVGWFLGWDDDYWSVDPLDRAMAELAA

SEQ ID NO: 853076 - protein, 494 aa, Homo sapiens [sequence omitted]

SEQ ID NO: 853077 - protein, 682 aa, Homo sapiens [sequence omitted]

SEQ ID NO: 853078 - protein, 682 aa, Homo sapiens [sequence omitted]

SEQ ID NO: 853079 - protein, 186 aa, Homo sapiens; identical to SEQ ID NO: 853072

SEQ ID NO: 853080 - protein, 682 aa, Homo sapiens [sequence omitted]

SEQ ID NO: 853081 - protein, 682 aa, Homo sapiens [sequence omitted]

SEQ ID NO: 853082 - protein, 103 aa, Homo sapiens
MLKAAAKRPELSGLLKFNNYGILSESPLTSQRTTWLLYQSPSFIPGFAYPSRCLKTIGGVYKQARKKHYIQQLRYGRSEVNVPGSSSKARATVCGRYNDNGAV

SEQ ID NO: 853083 - protein, 109 aa, Homo sapiens
NGKRRFLASCFQGDVDFFPSPVSPLPGATAEPSGKGCIYMAEVKSMFREVLPKQGPLFVEDIMTMVLCKPKLLPLKSLTLEKLEKMHQAAQNTIRQQEMAEKDQRQITH

SEQ ID NO: 853084 - protein, 103 aa, Homo sapiens; identical to SEQ ID NO: 853082

SEQ ID NO: 853085 - protein, 469 aa, Homo sapiens [sequence omitted]

SEQ ID NO: 853086 - protein, 469 aa, Homo sapiens [sequence omitted]

SEQ ID NO: 853087 - protein, 469 aa, Homo sapiens [sequence omitted]

SEQ ID NO: 853088 - protein, 283 aa, Homo sapiens
MLRDLNLGEMKSGVPVLAVSLALEGKASHREMTSKLLSDLCGTVMSTTDVEKSFDKLLKDLPELALDTPRAPQLVGQFIARAVGDGILCNTYIDSYKGTVDCVQARAALDKATVLLSMSKGGKRKDSVWGSGGGQQSVNHLVKEIDMLLKEYLLSGDISEAEHCLKELEVPHFHHELVYEAIIMVLESTGESTFKMILDLLKSLWKSSTITVDQMKRGYERIYNEIPDINLDVPHSYSVLERFVEECFQAGIISKQLRDLCPSRGRKRFVSEGDGGRLKPESY

SEQ ID NO: 853089 - protein, 283 aa, Homo sapiens; identical to SEQ ID NO: 853088

SEQ ID NO: 853090 - protein, 469 aa, Homo sapiens [sequence omitted]

SEQ ID NO: 853091 - protein, 263 aa, Homo sapiens
MDVENEQILNVNPADPDNLSDSLFSGDEENAGTEEVKNEINGNWISASSINEARINAKAKRRLRKNSSRDSGRGDSVSDSGSDALRSGLTVPTSPKGRLLDRRSRSGKGRGLPKKGGAGGKGVWGTPGQVYDVEEVDVKDPNYDDDQENCVYETVVLPLDERAFEKTLTPIIQEYFEHGDTNEVAEMLRDLNLGEMKSGVPVLAVSLALEGKASHREMTSKLLSDLCGTVMSTTDVESVKIVCGALEVGSNLSITLLKRLICC

SEQ ID NO: 853092 - protein, 336 aa, Homo sapiens
LVTLRIPQGLFPSKENCVYETVVLPLDERAFEKTLTPIIQEYFEHGDTNEVAEMLRDLNLGEMKSGVPVLAVSLALEGKASHREMTSKLLSDLCGTVMSTTDVEKSFDKLLKDLPELALDTPRAPQLVGQFIARAVGDGILCNTYIDSYKGTVDCVQARAALDKATVLLSMSKGGKRKDSVWGSGGGQQSVNHLVKEIDMLLKEYLLSGDISEAEHCLKELEVPHFHHELVYEAIIMVLESTGESTFKMILDLLKSLWKSSTITVDQMKRGYERIYNEIPDINLDVPHSYSVLERFVEECFQAGIISKQLRDLCPSRGRKRFVSEGDGGRLKPESY

SEQ ID NO: 853093 - protein, 433 aa, Homo sapiens [sequence omitted]

SEQ ID NO: 853094 - protein, 325 aa, Homo sapiens
LNRYQVALPLQTPATPERAFEKTLTPIIQEYFEHGDTNEVAEMLRDLNLGEMKSGVPVLAVSLALEGKASHREMTSKLLSDLCGTVMSTTDVEKSFDKLLKDLPELALDTPRAPQLVGQFIARAVGDGILCNTYIDSYKGTVDCVQARAALDKATVLLSMSKGGKRKDSVWGSGGGQQSVNHLVKEIDMLLKEYLLSGDISEAEHCLKELEVPHFHHELVYEAIIMVLESTGESTFKMILDLLKSLWKSSTITVDQMKRGYERIYNEIPDINLDVPHSYSVLERFVEECFQAGIISKQLRDLCPSRGRKRFVSEGDGGRLKPESY

SEQ ID NO: 853095 - protein, 469 aa, Homo sapiens [sequence omitted]

SEQ ID NO: 853096 - protein, 292 aa, Homo sapiens [sequence omitted]

SEQ ID NO: 853097 - protein, 469 aa, Homo sapiens [sequence omitted]

SEQ ID NO: 853098 - protein, 469 aa, Homo sapiens [sequence omitted]

SEQ ID NO: 853099 - protein, 455 aa, Homo sapiens [sequence omitted]

SEQ ID NO: 853100 - protein, 469 aa, Homo sapiens [sequence omitted]

SEQ ID NO: 853101 - protein, 469 aa, Homo sapiens [sequence omitted]

SEQ ID NO: 853102 - protein, 283 aa, Homo sapiens; identical to SEQ ID NO: 853088

SEQ ID NO: 853103 - protein, 337 aa, Homo sapiens [sequence omitted]

SEQ ID NO: 853104 - protein, 354 aa, Homo sapiens
MDVENEQILNVNPADPDNLSDSLFSGDEENAGTEEVKNEINGNWISASSINEARINAKAKRRLRKNSSRDSGRGDSVSDSGSDALRSGLTVPTSPKGRLLDRRSRSGKGRGLPKKGGAGGKGVWGTPGQVYDVEEVDVKDPNYDDDQENCVYETVVLPLDERAFEKTLTPIIQEYFEHGDTNEVAEMLRDLNLGEMKSGVPVLAVSLALEGKASHREMTSKLLSDLCGTVMSTTDVEKSFDKLLKDLPELALDTPRAPQLVGQFIARAVGDGILCNTYIDSYKGTVDCVQASTGRAAFEGCGRQMPADKHSAGGGGRRRGVNVVSLWKHVEQLSSSWSSGFFDELVGLKLDGQL

SEQ ID NO: 853105 - protein, 108 aa, Homo sapiens
SLSQPSLRQGTLQTRRLPLTDLSQLFCLSGRCWARTVEMSEKKQPVDLGLLEEDDEFEEFPAEDWAGLDEDEDAHVWEDNWDDDNVEDDFSNQLRAELEKHGYKMETS

SEQ ID NO: 853106 - protein, 120 aa, Homo sapiens
TLEDKDLLLDTDMPQSNCCIAFRHCWLNCPFTWHATHGKVKGEGDFLLHVALTKRADPAELRTIFLKYASIEKNGEFFMSPNDFVTRYLNIFGESQPNPKTVELLSGVVDQTKDGLGWLR

SEQ ID NO: 853107 - protein, 77 aa, Homo sapiens
DHYLREESRRHGVTAASAMIVSFLRPPQPHRTDWAGLDEDEDAHVWEDNWDDDNVEDDFSNQLRAELEKHGYKMETS

SEQ ID NO: 853108 - protein, 85 aa, Homo sapiens
MSEKKQPVDLGLLEEDDEFEEFPAEDWAGLDEDEDAHVWEDNWDDDNVEDDFSNQLRAELEKHGYKMDTLHPEDTLHPEDTLHPE

SEQ ID NO: 853109 - protein, 68 aa, Homo sapiens
RGSLNIRPGLLEEDDEFEEFPAEDWAGLDEDEDAHVWEDNWDDDNVEDDFSNQLRAELEKHGYKMETS

SEQ ID NO: 853110 - protein, 119 aa, Homo sapiens [sequence omitted]

SEQ ID NO: 853111 - protein, 104 aa, Homo sapiens
AQAGLHCCCWEEGKVCLLWHQQCRARLEGCGGCAGCSAQVDPGKQPLDAEWREPLSTARHQSPWRNRQGEVRPSSGSKQTGRGWGRGSGTRPPTLLRLCFYQSL

SEQ ID NO: 853112 - protein, 913 aa, Homo sapiens
MGDSRDLCPHLDSIGEVTKEDLLLKSKGTCQSCGVTGPNLWACLQVACPYVGCGESFADHSTIHAQAKKHNLTVNLTTFRLWCYACEKEVFLEQRLAAPLLGSSSKFSEQDSPPPSHPLKAVPIAVADEGESESEDDDLKPRGLTGMKNLGNSCYMNAALQALSNCPPLTQFFLECGGLVRTDKKPALCKSYQKLVSEVWHKKRPSYVVPTSLSHGIKLVNPMFRGYAQQDTQEFLRCLMDQLHEELKEPVVATVALTEARDSDSSDTDEKREGDRSPSEDEFLSCDSSSDRGEGDGQGRGGGSSQAETELLIPDEAGRVISEKERMKDRKFSWGQQRTNSEQVDEDADVDTAMAALDQPAEAQPPSPRSSSPCRTPEPDNDAHLRSSSRPCSPVHHHEGHAKLSSSPPRASPVRMAPSYVLKKAQVLSAGSRRRKEQRYRSVISDIFDGSILSLVQCLTCDRVSTTVETFQDLSLPIPGKEDLAKLHSAIYQNVPAKPGACGDSYAAQGWLAFIVEYIRRFVVSCTPSWFWGPVVTLEDCLAAFFAADELKGDNMYSCERCKKLRNGVKYCKVLRLPEILCIHLKRFRHEVMYSFKINSHVSFPLEGLDLRPFLAKECTSQITTYDLLSVICHHGTAGSGHYIAYCQNVINGQWYEFDDQYVTEVHETVVQNAEGYVLFYRKSSEEAMRERQQVVSLAAMREPSLLRFYVSREWLNKFNTFAEPGPITNQTFLCSHGGIPPHKYHYIDDLVVILPQNVWEHLYNRFGGGPAVNHLYVCSICQVEIEALAKRRRIEIDTFIKLNKAFQAEESPGVIYCISMQWFREWEAFVKGKDNEPPGPIDNSRIAQVKGSGHVQLKQGADYGQISEETWTYLNSLYGGGPEIAIRQSVAQPLGPENLHGEQKIEAETRAV

SEQ ID NO: 853113 - protein, 913 aa, Homo sapiens; identical to SEQ ID NO: 853112

SEQ ID NO: 853114 - protein, 913 aa, Homo sapiens; identical to SEQ ID NO: 853112

SEQ ID NO: 853115 - protein, 687 aa, Homo sapiens
MGDSRDLCPHLDSIGEVTKEDLLLKSKGTCQSCGVTGPNLWACLQVACPYVGCGESFADHSTIHAQAKKHNLTVNLTTFRLWCYACEKEVFLEQRLAAPLLGSSSKFSEQDSPPPSHPLKAVPIAVADEGESESEDDDLKPRGLTGMKNLGNSCYMNAALQALSNCPPLTQFFLECGGLVRTDKKPALCKSYQKLVSEVWHKKRPSYVVPTSLSHGIKLVNPMFRGYAQQDTQEFLRCLMDQLHEELKEPVVATVALTEARDSDSSDTDEKREGDRSPSEDEFLSCDSSSDRGEGDGQGRGGGSSQAETELLIPDEAGRVISEKERMKDRKFSWGQQRTNSEQVDEDADVDTAMAALDQPAEAQPPSPRSSSPCRTPVPLEGLDLRPFLAKECTSQITTYDLLSVICHHGTAGSGHYIAYCQNVINGQWYEFDDQYVTEVHETVVQNAEGYVLFYRKSSEEAMRERQQVVSLAAMREPSLLRFYVSREWLNKFNTFAEPGPITNQTFLCSHGGIPPHKYHYIDDLVVILPQNVWEHLYNRFGGGPAVNHLYVCSICQVEIEALAKRRRIEIDTFIKLNKAFQAEESPGVIYCISMQWFREWEAFVKGKDNEPPGPIDNSRIAQVKGSGHVQLKQGADYGQISEETWTYLNSLYGGGPEIAIRQSVAQPLGPENLHGEQKIEAETRAV

SEQ ID NO: 853116 - protein, 358 aa, Homo sapiens [sequence omitted]

SEQ ID NO: 853117 - protein, 913 aa, Homo sapiens; identical to SEQ ID NO: 853112

SEQ ID NO: 853118 - protein, 879 aa, Homo sapiens
MGDSRDLCPHLDSIGEVTKEDLLLKSKGTCQSCGVTGPNLWACLQVACPYVGCGESFADHSTIHAQAKKHNLTVNLTTFRLWCYACEKEVFLEQRLAAPLLGSSSKFSEQDSPPPSHPLKAVPIAVADEGESESEDDDLKPRGLTGMKNLGNSCYMNAALQALSNCPPLTQFFLECGGLVRTDKKPALCKSYQKLVSEVWHKKRPSYVVPTSLSHGIKLVNPMFRGYAQQDTQEFLRCLMDQLHEELKEPVVATVALTEARDSDSSDTDEKREGDRSPSEDEFLSCDSSSDRGEGDGQGRGGGSSQAETELLIPDEAGRVISEKERMKDRKFSWGQQRTNSEQVDEDADVDTAMAALDQPAEAQPPSPRSSSPCRTPEPDNDAHLRSSSRPCSPVHHHEGHAKLSSSPPRASPVRMAPSYVLKKAQVLSAGSRRRKEQRYRSVISDIFDGSILSLVQCLTCDRVSTTVETFQDLSLPIPGKEDLAKLHSAIYQNVPAKPGACGDSYAAQGWLAFIVEYIRRFVVSCTPSWFWGPVVTLEDCLAAFFAADELKGDNMYSCERCKKLRNGVKYCKVLRLPEILCIHLKRFRHEVMYSFKINSHVSFPLEGLDLRPFLAKECTSQITTYDLLSVICHHGTAGSGHYIAYCQNVINGQWYEFDDQYVTEVHETVVQNAEGYVLFYRKSSEEAMRERQQVVSLAAMREPSLLRFYVSREWLNKFNTFAEPGPITNQTFLCSHGGIPPHKYHYIDDLVVILPQNVWEHLYNRFGGGPAVNHLYVCSICQVEIEALAKRRRIEIDTFIKLNKAFQAEESPGVIYCISMQWFREWEAFVKGKDNEPPGPIDNSRIAQVKGSGHVQLKQGADYEQHKVFREQQENSKA

SEQ ID NO: 853119 - protein, 913 aa, Homo sapiens; identical to SEQ ID NO: 853112

SEQ ID NO: 853120 - protein, 913 aa, Homo sapiens; identical to SEQ ID NO: 853112

SEQ ID NO: 853121 - protein, 229 aa, Homo sapiens
MGGEVSGVQLFVISFVRMIIECVHIYVSREWLNKFNTFAEPGPITNQTFLCSHGGIPPHKYHYIDDLVVILPQNVWEHLYNRFGGGPAVNHLYVCSICQVEIEALAKRRRIEIDTFIKLNKAFQAEESPGVIYCISMQWFREWEAFVKGKDNEPPGPIDNSRIAQVKGSGHVQLKQGADYGQISEETWTYLNSLYGGGPEIAIRQSVAQPLGPENLHGEQKIEAETRAV

SEQ ID NO: 853122 - protein, 143 aa, Homo sapiens
ISCVLEIPSAGSSDCHRGALGGSGASSIRDFTLTPRPGAAPLGMALLLWRVEGMAGAEPEPAVSVAEPPGPIDNSRIAQVKGSGHVQLKQGADYGQISEETWTYLNSLYGGGPEIAIRQSVAQPLGPENLHGEQKIEAETRAV

SEQ ID NO: 853123 - protein, 546 aa, Homo sapiens
MGDSRDLCPHLDSIGEVTKEDLLLKSKGTCQSCGVTGPNLWACLQVACPYVGCGESFADHSTIHAQAKKHNLTVNLTTFRLWCYACEKEVFLEQRLAAPLLGSSSKFSEQDSPPPSHPLKAVPIAVADEGESESEDDDLKPRGLTGMKNLGNSCYMNAALQALSNCPPLTQFFLECGGLVRTDKKPALCKSYQKLVSEVWHKKRPSYVVPTSLSHGIKLVNPMFRGYAQQDTQEFLRCLMDQLHEELKEPVVATVALTEARDSDSSDTDEKREGDRSPSEDEFLSCDSSSDRGEGDGQGRGGGSSQAETELLIPDEAGRVISEKERMKDRKFSWGQQRTNSEQVDEDADVDTAMAALDQPAEAQPPSPRSSSPCRTPEPDNDAHLRSSSRPCSPVHHHEGHAKLSSSPPRASPVRMAPSYVLKKAQVLSAGSRRRKEQRYRSVISDIFDGSILSLVQCLTCDRVSTTVETFQDLSLPIPGKEDLAKLHSAIYQNVPAKPGACGDSYAAQGWLAFIVEYIRRCAHLATTGRHGLGLSWFSWAGDSTQ

SEQ ID NO: 853124 - protein, 655 aa, Homo sapiens
MERKVLALQARKKRTKAKKDKAQRKSETQHRGSAPHSESDLPEQEEEILGSDDDEQEDPNDYCKGGYHLVKIGDLFNGRYHVIRKLGWGHFSTVWLSWDIQGKKFVAMKVVKSAEHYTETALDEIRLLKSVRNSDPNDPNREMVVQLLDDFKISGVNGTHICMVFEVLGHHLLKWIIKSNYQGLPLPCVKKIIQQVLQGLDYLHTKCRIIHTDIKPENILLSVNEQYIRRLAAEATEWQRSGAPPPSGSAVSTAPQPKPADKMSKNKKKKLKKKQKRQAELLEKRMQEIEEMEKESGPGQKRPNKQEESESPVERPLKENPPNKMTQEKLEESSTIGQDQTLMERDTEGGAAEINCNGVIEVINYTQNSNNETLRHKEDLHNANDCDVQNLNQESSFLSSQNGDSSTSQETDSCTPITSEVSDTMVCQSSSTVGQSFSEQHISQLQESIRAEIPCEDEQEQEHNGPLDNKGKSTAGNFLVNPLEPKNAEKLKVKIADLGNACWVHKHFTEDIQTRQYRSLEVLIGSGYNTPADIWSTACMAFELATGDYLFEPHSGEEYTRDEDHIALIIELLGKVPRKLIVAGKYSKEFFTKKGDLKHITKLKPWGLFEVLVEKYEWSQEEAAGFTDFLLPMLELIPEKRATAAECLRHPWLNS

SEQ ID NO: 853125 - protein, 871 aa, Homo sapiens
RAASWGGGGAGLRAECERARFWAAAGAGVAATRVRRRLAITGLTMERKGERWSGLRHEGQWSPGRGPGQRRELRLTAAVRFPDVRRPSTEVAPPHTPCLWAAGPRPSVRASSGAGRSRPLFPARPARALGPLQGPALGGRRRPPPARPLTRPETPPAHPARALLCAPWAASPTAGRLAGARSRPRGRPRSRAWRPCWVSTLTLVASFPPHSPFIHPSLLQVLALQARKKRTKAKKDKAQRKSETQHRGSAPHSESDLPEQEEEILGSDDDEQEDPNDYCKGGYHLVKIGDLFNGRYHVIRKLGWGHFSTVWLSWDIQGKKFVAMKVVKSAEHYTETALDEIRLLKSVRNSDPNDPNREMVVQLLDDFKISGVNGTHICMVFEVLGHHLLKWIIKSNYQGLPLPCVKKIIQQVLQGLDYLHTKCRIIHTDIKPENILLSVNEQYIRRLAAEATEWQRSGAPPPSGSAVSTAPQPKPADKMSKNKKKKLKKKQKRQAELLEKRMQEIEEMEKESGPGQKRPNKQEESESPVERPLKENPPNKMTQEKLEESSTIGQDQTLMERDTEGGAAEINCNGVIEVINYTQNSNNETLRHKEDLHNANDCDVQNLNQESSFLSSQNGDSSTSQETDSCTPITSEVSDTMVCQSSSTVGQSFSEQHISQLQESIRAEIPCEDEQEQEHNGPLDNKGKSTAGNFLVNPLEPKNAEKLKVKIADLGNACWVHKHFTEDIQTRQYRSLEVLIGSGYNTPADIWSTACMAFELATGDYLFEPHSGEEYTRDEDHIALIIELLGKVPRKLIVAGKYSKEFFTKKGDLKHITKLKPWGLFEVLVEKYEWSQEEAAGFTDFLLPMLELIPEKRATAAECLRHPWLNS

SEQ ID NO: 853126 - protein, 639 aa, Homo sapiens
MGIFVSFLRSETQHRGSAPHSESDLPEQEEEILGSDDDEQEDPNDYCKGGYHLVKIGDLFNGRYHVIRKLGWGHFSTVWLSWDIQGKKFVAMKVVKSAEHYTETALDEIRLLKSVRNSDPNDPNREMVVQLLDDFKISGVNGTHICMVFEVLGHHLLKWIIKSNYQGLPLPCVKKIIQQVLQGLDYLHTKCRIIHTDIKPENILLSVNEQYIRRLAAEATEWQRSGAPPPSGSAVSTAPQPKPADKMSKNKKKKLKKKQKRQAELLEKRMQEIEEMEKESGPGQKRPNKQEESESPVERPLKENPPNKMTQEKLEESSTIGQDQTLMERDTEGGAAEINCNGVIEVINYTQNSNNETLRHKEDLHNANDCDVQNLNQESSFLSSQNGDSSTSQETDSCTPITSEVSDTMVCQSSSTVGQSFSEQHISQLQESIRAEIPCEDEQEQEHNGPLDNKGKSTAGNFLVNPLEPKNAEKLKVKIADLGNACWVHKHFTEDIQTRQYRSLEVLIGSGYNTPADIWSTACMAFELATGDYLFEPHSGEEYTRDEDHIALIIELLGKVPRKLIVAGKYSKEFFTKKGDLKHITKLKPWGLFEVLVEKYEWSQEEAAGFTDFLLPMLELIPEKRATAAECLRHPWLNS

SEQ ID NO: 853127 - protein, 367 aa, Homo sapiens
MFSHVFMSLSISSRKCFNLVRNVSVLSLTHICIYLFLFVCSLEESSTIGQDQTLMERDTEGGAAEINCNGVIEVINYTQNSNNETLRHKEDLHNANDCDVQNLNQESSFLSSQNGDSSTSQETDSCTPITSEVSDTMVCQSSSTVGQSFSEQHISQLQESIRAEIPCEDEQEQEHNGPLDNKGKSTAGNFLVNPLEPKNAEKLKVKIADLGNACWVHKHFTEDIQTRQYRSLEVLIGSGYNTPADIWSTACMAFELATGDYLFEPHSGEEYTRDEDHIALIIELLGKVPRKLIVAGKYSKEFFTKKGDLKHITKLKPWGLFEVLVEKYEWSQEEAAGFTDFLLPMLELIPEKRATAAECLRHPWLNS

SEQ ID NO: 853128 - protein, 350 aa, Homo sapiens
MFSHVFMSLSISSRKCFNLVRNVSVLSLTHICIYLFLFVCSLEESSTIGQDQTLMERDTEGGAAEINCNGVIEVINYTQNSNNETLRHKEDLHNANDCDVQNLNQESSFLSSQNGDSSTSQETDSCTPITSEVSDTMVCQSSSTVGQSFSEQHISQLQESIRAEIPCEDEQEQEHNGPLDNKGKSTAGNFLVNPLEPKNHKHFTEDIQTRQYRSLEVLIGSGYNTPADIWSTACMAFELATGDYLFEPHSGEEYTRDEDHIALIIELLGKVPRKLIVAGKYSKEFFTKKGDLKHITKLKPWGLFEVLVEKYEWSQEEAAGFTDFLLPMLELIPEKRATAAECLRHPWLNS

SEQ ID NO: 853129 - protein, 699 aa, Homo sapiens
RAASWGGGGAGLRAECERARFWAAAGAGVAATRVRRRLAITGLTMERKVLALQARKKRTKAKKDKAQRKSETQHRGSAPHSESDLPEQEEEILGSDDDEQEDPNDYCKGGYHLVKIGDLFNGRYHVIRKLGWGHFSTVWLSWDIQGKKFVAMKVVKSAEHYTETALDEIRLLKSVRNSDPNDPNREMVVQLLDDFKISGVNGTHICMVFEVLGHHLLKWIIKSNYQGLPLPCVKKIIQQVLQGLDYLHTKCRIIHTDIKPENILLSVNEQYIRRLAAEATEWQRSGAPPPSGSAVSTAPQPKPADKMSKNKKKKLKKKQKRQAELLEKRMQEIEEMEKESGPGQKRPNKQEESESPVERPLKENPPNKMTQEKLEESSTIGQDQTLMERDTEGGAAEINCNGVIEVINYTQNSNNETLRHKEDLHNANDCDVQNLNQESSFLSSQNGDSSTSQETDSCTPITSEVSDTMVCQSSSTVGQSFSEQHISQLQESIRAEIPCEDEQEQEHNGPLDNKGKSTAGNFLVNPLEPKNAEKLKVKIADLGNACWVHKHFTEDIQTRQYRSLEVLIGSGYNTPADIWSTACMAFELATGDYLFEPHSGEEYTRDEDHIALIIELLGKVPRKLIVAGKYSKEFFTKKGDLKHITKLKPWGLFEVLVEKYEWSQEEAAGFTDFLLPMLELIPEKRATAAECLRHPWLNS

SEQ ID NO: 853130 - protein, 74 aa, Homo sapiens
ELSQGCRRHSAAVALFSGISSNMGSKKSVKPAASSCDHSYFSTENLKKAPRFQLRDMFQVTFFLIQHVHLGLLT

SEQ ID NO: 853131 - protein, 533 aa, Homo sapiens
RAASWGGGGAGLRAECERARFWAAAGAGVAATRVRRRLAITGLTMERKVLALQARKKRTKAKKDKAQRKSETQHRGSAPHSESDLPEQEEEILGSDDDEQEDPNDYCKGGYHLVKIGDLFNGRYHVIRKLGWGHFSTVWLSWDIQGKKFVAMKVVKSAEHYTETALDEIRLLKSVRNSDPNDPNREMVVQLLDDFKISGVNGTHICMVFEVLGHHLLKWIIKSNYQGLPLPCVKKIIQQVLQGLDYLHTKCRIIHTDIKPENILLSVNEQYIRRLAAEATEWQRSGAPPPSGSAVSTAPQPKPADKMSKNKKKKLKKKQKRQAELLEKRMQEIEEMEKESGPGQKRPNKQEESESPVERPLKENPPNKMTQEKLEESSTIGQDQTLMERDTEGGAAEINCNGVIEVINYTQNSNNETLRHKEDLHNANDCDVQNLNQESSFLSSQNGDSSTSQETDSCTPITSEVSDTMVCQSSSTVGQSFSEQHISQLQESIRAEIPCEDEQEQEHNGPLDNKVLLMMPVVCRKIHGWKFSC

SEQ ID NO: 853132 - protein, 699 aa, Homo sapiens; identical to SEQ ID NO: 853129

SEQ ID NO: 853133 - protein, 681 aa, Homo sapiens
RAASWGGGGAGLRAECERARFWAAAGAGVAATRVRRRLAITGLTMERKVLALQARKKRTKAKKDKAQRKSETQHRGSAPHSESDLPEQEEEILGSDDDEQEDPNDYCKGGYHLVKIGDLFNGRYHVIRKLGWGHFSTVWLSWDIQGKKFVAMKVVKSAEHYTETALDEIRLLKSVRNSDPNDPNREMVVQLLDDFKISGVNGTHICMVFEVLGHHLLKWIIKSNYQGLPLPCVKKIIQQVLQGLDYLHTKCRIIHTDIKPENILLSVNEQYIRRLAAEATEWQRSGAPPPSGSAVSTAPQPKPADKMSKNKKKKLKKKQKRQAELLEKRMQEIEEMEKESGPGQKRPNKQEESESPVERPLKENPPNKMTQEKLEESSTIGQDQTLMERDTEGGAAEINCNGVIEVINYTQNSNNETLRHKEDLHNANDCDVPSQETDSCTPITSEVSDTMVCQSSSTVGQSFSEQHISQLQESIRAEIPCEDEQEQEHNGPLDNKGKSTAGNFLVNPLEPKNAEKLKVKIADLGNACWVHKHFTEDIQTRQYRSLEVLIGSGYNTPADIWSTACMAFELATGDYLFEPHSGEEYTRDEDHIALIIELLGKVPRKLIVAGKYSKEFFTKKGDLKHITKLKPWGLFEVLVEKYEWSQEEAAGFTDFLLPMLELIPEKRATAAECLRHPWLNS

SEQ ID NO: 853134 - protein, 699 aa, Homo sapiens; identical to SEQ ID NO: 853129

SEQ ID NO: 853135 - protein, 198 aa, Homo sapiens
MSISQLQESIRAEIPCEDEQEQEHNGPLDNKGKSTAGNFLVNPLEPKNAEKLKVKIADLGNACWVHKHFTEDIQTRQYRSLEVLIGSGYNTPADIWSTACMAFELATGDYLFEPHSGEEYTRDEDHIALIIELLGKVPRKLIVAGKYSKEFFTKKVEKYEWSQEEAAGFTDFLLPMLELIPEKRATAAECLRHPWLNS

SEQ ID NO: 853136 - protein, 721 aa, Homo sapiens
RAASWGGGGAGLRAECERARFWAAAGAGVAATRVRRRLAITGLTMERKVLALQARKKRTKAKKDKAQRKSETQHRGSAPHSESDLPEQEEEILGSDDDEQEDPNDYCKGGYHLVKIGDLFNGRYHVIRKLGWGHFSTVWLSWDIQGKKFVAMKVVKSAEHYTETALDEIRLLKSVRNSDPNDPNREMVVQLLDDFKISGVNGTHICMVFEVLGHHLLKWIIKSNYQGLPLPCVKKIIQQVLQGLDYLHTKCRIIHTDIKPENILLSVNEQYIRRLAAEATEWQRSGAPPPSGSAVSTAPQPKPADKMSKNKKKKLKKKQKRQAELLEKRMQEIEEMEKESGPGQKRPNKQEESESPVERPLKENPPNKMTQEKLEESSTIGQDQTLMERDTEGGAAEINCNGVIEVINYTQNSNNETLRHKEDLHNANDCDVQNLNQESSFLSSQNGDSSTSQETDSCTPITSEVSDTMVCQSSSTVGQSFSEQHISQLQESIRAEIPCEDEQEQEHNGPLDNKGKSTAGNFLVNPLEPKNAEKLKVKIADLGNACWVHKHFTEDIQTRQYRSLEVLIGSGYNTPADIWSTACMAFELATGDYLFEPHSGEEYTRDEDHIALIIELLGKVPRKLIVAGKYSKEFFTKKGLKHITKLKPCGHKRATKREKVREDARQKAGGLNRIIKPMVEDDPEEEEPRARGNTEPGVNSKAEKSTAKSKANRDDLSILTQ

SEQ ID NO: 853137 - protein, 852 aa, Homo sapiens
MKPMLKDFSNLLLVVLCDYVLGEAEYLLLREPGHVALSNDTVYVDFQYFDGANGTLRNVSVLLLEANTNQTVTTKYLLTNQSQGTLKFECFYFKEAGDYWFTMTPEATDNSTPFPWWEKSAFLKVEWPVFHVDLNRSAKAAEGTFQVGLFTSQPLCPFPVDKPNIVVDVIFTNSLPEARRNSRQPLEIRTSKRTELAQGQWVEFGCAPLGPEAYVTVVLKLLGRDSVITSTGPIDLAQKFGYKLVMVPELTCESGVEVTVLPPPCTFVQGVVTVFKEAPRYPGKRTIHLAENSLPLGERRTIFNCTLFDMGKNKYCFDFGISSRSHFSAKEECMLIQRNTETWGLWQPWSQCSATCGDGVRERRRVCLTSFPSSPVCPGMSLEASLCSLEECAAFQPSSPSPLQPQGPVKSNNIVTVTGISLCLFIIIATVLITLWRRFGRPAKCSTPARHNSIHSPSFRKNSDEENICELSEQRGSFSDGGDGPTGSPGDTGIPLTYRRSGPVPPEDDASGSESFQSNAQKIIPPLFSYRLAQQQLKEMKKKGLTETTKVYHVSQSPLTDTAIDAAPSAPLDLESPEEAAANKFRIKSPFPEQPAVSAGERPPSRLDLNVTQASCAISPSQTLIRKSQARHVGSRGGPSERSHARNAHFRRTASFHEARQARPFRERSMSTLTPRQAPAYSSRTRTCEQAEDRFRPQSRGAHLFPEKLEHFQEASGTRGPLNPLPKSYTLGQPLRKPDLGDHQAGLVAGIERTEPHRARRGPSPSHKSVSRKQSSPISPKDNYQRVSSLSPSQCRKDKCQSFPTHPEFAFYDNTSFGLTEAEQRMLDLPGYFGSNEEDETTSTLSVEKLVI

SEQ ID NO: 853138 - protein, 852 aa, Homo sapiens; identical to SEQ ID NO: 853137

SEQ ID NO: 853139 - protein, 852 aa, Homo sapiens; identical to SEQ ID NO: 853137

SEQ ID NO: 853140 - protein, 488 aa, Homo sapiens
WRSTSPPLSLPVRLATRPDGLGLLPVSLESFPAIQPISSSAPGPVKSNNIVTVTGISLCLFIIIATVLITLWRRFGRPAKCSTPARHNSIHSPSFRKNSDEENICELSEQRGSFSDGGDGPTGSPGDTGIPLTYRRSGPVPPEDDASGSESFQSNAQKIIPPLFSYRLAQQQLKEMKKKGLTETTKVYHVSQSPLTDTAIDAAPSAPLDLESPEEAAANKFRIKSPFPEQPAVSAGERPPSRLDLNVTQASCAISPSQTLIRKSQARHVGSRGGPSERSHARNAHFRRTASFHEARQARPFRERSMSTLTPRQAPAYSSRTRTCEQAEDRFRPQSRGAHLFPEKLEHFQEASGTRGPLNPLPKSYTLGQPLRKPDLGDHQAGLVAGIERTEPHRARRGPSPSHKSVSRKQSSPISPKDNYQRVSSLSPSQCRKDKCQSFPTHPEFAFYDNTSFGLTEAEQRMLDLPGYFGSNEEDETTSTLSVEKLVI

SEQ ID NO: 853141 - protein, 135 aa, Homo sapiens
PAGLWEPNAAGSGRAVWDAGCLALYLAAPEPSRPPRHAPGRPGVAARQSRKVRSALRILVFAPVPRDSWRLLWGREMPPDSATSPQPEGAGGRWRPLPTPASAPGDAFKGYWSPHFGVPNLSEPGSALAQMLPSD

SEQ ID NO: 853142 - protein, 211 aa, Homo sapiens
QRLLRRRKAARPSRLLRFLGGGGMEARFTRGKSALLERALARPRTEVSLSAFALLFSELVQHCQSRVFSVAELQSRLAALGRQVGARVLDALVAREKGARRETKVLGALLFVKGAVWKALFGKEADKLEQANDDARTFYIIEREPLINTYISVPKENSTLNCASFTAGIVEAVLTHSGFPAKVTAHWHKGTTLMIKFEEAVIARDRALEGR

SEQ ID NO: 853143 - protein, 376 aa, Homo sapiens
TLHPLYSGFPQGAGRKVPEGRLCWSAGRGRSDCPYPLVVPHLCHLPALDLTPLPPYTSFLVTPVGGGAGRKALSQLNRLHARGLGGFGLLFCSPSCLSSHLVPTPASPLPAEGIRLPPPLIYLVTCNRGVFYAHLFASGKSALEHTTVAWVEGVPGPLAVLPPFLPACSPSHCPRHLHFLVSPQGGGGMEARFTRGKSALLERALARPRTEVSLSAFALLFSELVQHCQSRVFSVAELQSRLAALGRQVGARVLDALVAREKGARRETKVLGALLFVKGAVWKALFGKEADKLEQANDDARTFYIIEREPLINTYISVPKENSTLNCASFTAGIVEAVLTHSGFPAKVTAHWHKGTTLMIKFEEAVIARDRALEGR

SEQ ID NO: 853144 - protein, 188 aa, Homo sapiens
MEARFTRGKSALLERALARPRTEVSLSAFALLFSELVQHCQSRVFSVAELQSRLAALGRQVGARVLDALVAREKGARRETKVLGALLFVKGAVWKALFGKEADKLEQANDDARTFYIIEREPLINTYISVPKENSTLNCASFTAGIVEAVLTHSGFPAKVTAHWHKGTTLMIKFEEAVIARDRALEGR

SEQ ID NO: 853145 - protein, 312 aa, Homo sapiens
TLHPLYSGFPQGAGRKVPEGRLCWSAGRGRSDCPYPLVVPHLCHLPALDLTPLPPYTSFLVTPVGGGAGRKALSQLNRLHARGLGGFGLLFCSPSCLSSHLVPTPASPLPAEGIRLPPPLIYLVTCNRGVFYAHLFASGKSALEHTTVAWVEGVPGPLAVSPSFPPGLLPFPLPLTPALPGLPAGWRRHGGALHAREVGAAGARAGAAAHRVVKGAVWKALFGKEADKLEQANDDARTFYIIEREPLINTYISVPKENSTLNCASFTAGIVEAVLTHSGFPAKVTAHWHKGTTLMIKFEEAVIARDRALEGR

SEQ ID NO: 853146 - protein, 211 aa, Homo sapiens; identical to SEQ ID NO: 853142

SEQ ID NO: 853147 - protein, 268 aa, Homo sapiens
QRLLRRRKAARPSRLLRFLVRPYPPPCPRRASSAPRPLPRGRVGPGLGSRRPRSRARSLRPPSGGCEEGGFLPSVEGGGGMEARFTRGKSALLERALARPRTEVSLSAFALLFSELVQHCQSRVFSVAELQSRLAALGRQVGARVLDALVAREKGARRETKVLGALLFVKGAVWKALFGKEADKLEQANDDARTFYIIEREPLINTYISVPKENSTLNCASFTAGIVEAVLTHSGFPAKVTAHWHKGTTLMIKFEEAVIARDRALEGR

SEQ ID NO: 853148 - protein, 151 aa, Homo sapiens
GRASARSICADFPRVKRASSRRQVGARVLDALVAREKGARRETKVLGALLFVKGAVWKALFGKEADKLEQANDDARTFYIIEREPLINTYISVPKENSTLNCASFTAGIVEAVLTHSGFPAKVTAHWHKGTTLMIKFEEAVIARDRALEGR

SEQ ID NO: 853149 - protein, 320 aa, Homo sapiens
TLHPLYSGFPQGAGRKVPEGRLCWSAGRGRSDCPYPLVVPHLCHLPALDLTPLPPYTSFLVTPVGGGAGRKALSQLNRLHARGLGGFGLLFCSPSCLSSHLVPTPASPLPAEGIRLPPPLIYLVTCNRGVFYAHLFASGKSALEHTTVAWVEGVPGPLAVLPPFLPACSPSHCPRHLHFLVSPQGGGGMEARFTRGKSALLERALARPRTEVSLSAFALLFSELVQHCQSRVFSVAELQSRLAALGRQVGARVLDALVAREKGARRETKVLGALLFVKGAVWKALFGKEAASRRASWRRCSHTAASLPRSRRTGTRAPRS

SEQ ID NO: 853150 - protein, 1450 aa, Homo sapiens
QAIAEKQPSQEVKMEAKMEVDQPEPADTQPEDISESKVEDCKMESTETEERSTELKTEIKEEEDQPSTSATQSSPAPGQSKKKIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDRFVYTCNECKHHVETRWHCTVCEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTSQPQPTPPNSMPPYLPRTQAAGPVSQGKAAGQVTPPTPPQTAQPPLPGPPPAAVEMAMQIQRAAETQRQMAHVQIFQRPIQHQMPPMTPMAPMGMNPPPMTRGPSGHLEPGMGPTGMQQQPPWSQGGLPQPQQLQSGMPRPAMMSVAQHGQPLNMAPQPGLGQVGISPLKPGTVSQQALQNLLRTLRSPSSPLQQQQVLSILHANPQLLAAFIKQRAAKYANSNPQPIPGQPGMPQGQPGLQPPTMPGQQGVHSNPAMQNMNPMQAGVQRAGLPQQQPQQQLQPPMGGMSPQAQQMNMNHNTMPSQFRDILRRQQMMQQQQQQGAGPGIGPGMANHNQFQQPQGVGYPPQQQQRMQHHMQQMQQGNMGQIGQLPQALGAEAGASLQAYQQRLLQQQMGSPVQPNPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 853151 - protein, 1450 aa, Homo sapiens
QAIAEKQPSQEVKMEAKMEVDQPEPADTQPEDISESKVEDCKMESTETEERSTELKTEIKEEEDQPSTSATQSSPAPGQSKKKIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDRFVYTCNECKHHVETRWHCTVCEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTADASATVVTVVEPYLDPDRDPPRAQGSSCLTISAASRGGARCSATPSRAPTCSSGNGNADSESSGDAAPDGPRANFSKANPTPDAPDDSHGPHGYEPTSHDQRSQWAFGARDGTDRDAATATLEPRRIASAPATTVWDAKASHDVSGPAWSTFEHGSTTRIGPGRYQPTKPGTVSQQALQNLLRTLRSPSSPLQQQQVLSILHANPQLLAAFIKQRAAKYANSNPQPIPGQPGMPQGQPGLQPPTMPGQQGVHSNPAMQNMNPMQAGVQRAGLPQQQPQQQLQPPMGGMSPQAQQMNMNHNTMPSQFRDILRRQQMMQQQQQQGAGPGIGPGMANHNQFQQPQGVGYPPQQQQRMQHHMQQMQQGNMGQIGQLPQALGAEAGASLQAYQQRLLQQQMGSPVQPNPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 853152 - protein, 1532 aa, Homo sapiens
QAIAEKQPSQEVKMEAKMEVDQPEPADTQPEDISESKVEDCKMESTETEERSTELKTEIKEEEDQPSTSATQSSPAPGQSKKKIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDRFVYTCNECKHHVETRWHCTVCEVGTGLWEGGGELRRVVLRGHAATYFIEACGMLGAVASCLRGRAEEASFCSTKGAFLAQTISKILLNDLNLGEFTCTSCFFPEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTSQPQPTPPNSMPPYLPRTQAAGPVSQGKAAGQVTPPTPPQTAQPPLPGPPPAAVEMAMQIQRAAETQRQMAHVQIFQRPIQHQMPPMTPMAPMGMNPPPMTRGPSGHLEPGMGPTGMQQQPPWSQGGLPQPQQLQSGMPRPAMMSVAQHGQPLNMAPQPGLGQVGISPLKPGTVSQQALQNLLRTLRSPSSPLQQQQVLSILHANPQLLAAFIKQRAAKYANSNPQPIPGQPGMPQGQPGLQPPTMPGQQGVHSNPAMQNMNPMQAGVQRAGLPQQQPQQQLQPPMGGMSPQAQQMNMNHNTMPSQFRDILRRQQMMQQQQQQGAGPGIGPGMANHNQFQQPQGVGYPPQQQQRMQHHMQQMQQGNMGQIGQLPQALGAEAGASLQAYQQRLLQQQMGSPVQPNPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 853153 - protein, 882 aa, Homo sapiens
QAIRLGSVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDRFVYTCNECKHHVETRWHCTVCEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTSQPQPTPPNSMPPYLPRTQAAGPVSQGKAAGQVTPPTPPQTAQPPLPGPPPAAVEMAMQIQRAAETQRQMAHVQIFQRPIQHQMPPMTPMAPMGMNPPPMTRGPSGHLEPGMGPTGMQQQPPWSQGGLPQPQQLQSGMPRPAMMSVAQHGQPLNMAPQPGLGQVGISPLKPGTVSQQALQNLLRTLRSPSSPLQQQQVLSILHANPQLLAAFIKQRAAKYANSNPQPIPGQPGMPQGQPGLQPPTMPGQQGVHSNPAMQNMNPMQAGVQRAGLPQQQPQQQLQPPMGGMSPQAQQMNMNHNTMPSQFRDILRRQQMMQQQQQQGAGPGIGPGMANHNQFQQPQGVGYPPQQQQRMQHHMQQMQQGNMGQIGQLPQALGAEAGASLQAYQQRLLQQQMGSPVQPNPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 853154 - protein, 835 aa, Homo sapiens
DSRDPSRVPEKHKEVFFVIRLIAGPAANSLPPIVDPDPLIPCDLMDGRDAFLTLARDKHLEFSSLRRAQWSTMCMLVELHTQSQDRFVYTCNECKHHVETRWHCTVCEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTSQPQPTPPNSMPPYLPRTQAAGPVSQGKAAGQVTPPTPPQTAQPPLPGPPPAAVEMAMQIQRAAETQRQMAHVQIFQRPIQHQMPPMTPMAPMGMNPPPMTRGPSGHLEPGMGPTGMQQQPPWSQGGLPQPQQLQSGMPRPAMMSVAQHGQPLNMAPQPGLGQVGISPLKPGTVSQQALQNLLRTLRSPSSPLQQQQVLSILHANPQLLAAFIKQRAAKYANSNPQPIPGQPGMPQGQPGLQPPTMPGQQGVHSNPAMQNMNPMQAGVQRAGLPQQQPQQQLQPPMGGMSPQAQQMNMNHNTMPSQFRDILRRQQMMQQQQQQGAGPGIGPGMANHNQFQQPQGVGYPPQQQQRMQHHMQQMQQGNMGQIGQLPQALGAEAGASLQAYQQRLLQQQMGSPVQPNPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 853155 - protein, 873 aa, Homo sapiens
MDGRDAFLTLARDKHLEFSSLRRAQWSTMCMLVELHTQSQDRFVYTCNECKHHVETRWHCTVCEVGTGLWEGGGELRRVVLRGHAATYFIEACGMLGAVASCLRGRAEEASFCSTKGAFLAQTISKILLNDLNLGEFTCTSCFFPEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTSQPQPTPPNSMPPYLPRTQAAGPVSQGKAAGQVTPPTPPQTAQPPLPGPPPAAVEMAMQIQRAAETQRQMAHVQIFQRPIQHQMPPMTPMAPMGMNPPPMTRGPSGHLEPGMGPTGMQQQPPWSQGGLPQPQQLQSGMPRPAMMSVAQHGQPLNMAPQPGLGQVGISPLKPGTVSQQALQNLLRTLRSPSSPLQQQQVLSILHANPQLLAAFIKQRAAKYANSNPQPIPGQPGMPQGQPGLQPPTMPGQQGVHSNPAMQNMNPMQAGVQRAGLPQQQPQQQLQPPMGGMSPQAQQMNMNHNTMPSQFRDILRRQQMMQQQQQQGAGPGIGPGMANHNQFQQPQGVGYPPQQQQRMQHHMQQMQQGNMGQIGQLPQALGAEAGASLQAYQQRLLQQQMGSPVQPNPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 853156 - protein, 167 aa, Homo sapiens
CIRVWDAVFLFHLFQVSSQPVSVSVSSEDPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 853157 - protein, 375 aa, Homo sapiens
QAIAEKQPSQEVKMEAKMEVDQPEPADTQPEDISESKVEDCKMESTETEERSTELKTEIKEEEDQPSTSATQSSPAPGQSKKKIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVVYSGIL

SEQ ID NO: 853158 - protein, 233 aa, Homo sapiens
QAIAEKQPSQEVKMEAKMEVDQPEPADTQPEDISESKVEDCKMESTETEERSTELKTEIKEEEDQPSTSATQSSPAPGQSKKKIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNR

SEQ ID NO: 853159 - protein, 146 aa, Homo sapiens
MKQQRTAAGGGRRAQATRASRRGAPADGSTKQDRQTQGGTAATDQNARGTPGRQQQKEDSATSNKSRKQDRPDEWKLTQAATGTDTAAEQARAKSPGQSGRQGQTDTQTQPPQHRPDASRGRDQHEHEATGKCSKKYQQRARPKRQ

SEQ ID NO: 853160 - protein, 146 aa, Homo sapiens; identical to SEQ ID NO: 853159

SEQ ID NO: 853161 - protein, 1485 aa, Homo sapiens
MPATSTFPAIYNSERQVLHCPSTTSIDVISRRPIAEKHAFPGTQYGCRALSVVHPGKPYILRPEAVFQTSVVARLLPWASTETEERSTELKTEIKEEEDQPSTSATQSSPAPGQSKKKIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDRFVYTCNECKHHVETRWHCTVCEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTSQPQPTPPNSMPPYLPRTQAAGPVSQGKAAGQVTPPTPPQTAQPPLPGPPPAAVEMAMQIQRAAETQRQMAHVQIFQRPIQHQMPPMTPMAPMGMNPPPMTRGPSGHLEPGMGPTGMQQQPPWSQGGLPQPQQLQSGMPRPAMMSVAQHGQPLNMAPQPGLGQVGISPLKPGTVSQQALQNLLRTLRSPSSPLQQQQVLSILHANPQLLAAFIKQRAAKYANSNPQPIPGQPGMPQGQPGLQPPTMPGQQGVHSNPAMQNMNPMQAGVQRAGLPQQQPQQQLQPPMGGMSPQAQQMNMNHNTMPSQFRDILRRQQMMQQQQQQGAGPGIGPGMANHNQFQQPQGVGYPPQQQQRMQHHMQQMQQGNMGQIGQLPQALGAEAGASLQAYQQRLLQQQMGSPVQPNPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 853162 - protein, 934 aa, Homo sapiens
MFSQDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDRFVYTCNECKHHVETRWHCTVCEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTSQPQPTPPNSMPPYLPRTQAAGPVSQGKAAGQVTPPTPPQTAQPPLPGPPPAAVEMAMQIQRAAETQRQMAHVQIFQRPIQHQMPPMTPMAPMGMNPPPMTRGPSGHLEPGMGPTGMQQQPPWSQGGLPQPQQLQSGMPRPAMMSVAQHGQPLNMAPQPGLGQVGISPLKPGTVSQQALQNLLRTLRSPSSPLQQQQVLSILHANPQLLAAFIKQRAAKYANSNPQPIPGQPGMPQGQPGLQPPTMPGQQGVHSNPAMQNMNPMQAGVQRAGLPQQQPQQQLQPPMGGMSPQAQQMNMNHNTMPSQFRDILRRQQMMQQQQQQGAGPGIGPGMANHNQFQQPQGVGYPPQQQQRMQHHMQQMQQGNMGQIGQLPQALGAEAGASLQAYQQRLLQQQMGSPVQPNPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 853163 - protein, 791 aa, Homo sapiens
MDGRDAFLTLARDKHLEFSSLRRAQWSTMCMLVELHTQSQDRFVYTCNECKHHVETRWHCTVCEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTSQPQPTPPNSMPPYLPRTQAAGPVSQGKAAGQVTPPTPPQTAQPPLPGPPPAAVEMAMQIQRAAETQRQMAHVQIFQRPIQHQMPPMTPMAPMGMNPPPMTRGPSGHLEPGMGPTGMQQQPPWSQGGLPQPQQLQSGMPRPAMMSVAQHGQPLNMAPQPGLGQVGISPLKPGTVSQQALQNLLRTLRSPSSPLQQQQVLSILHANPQLLAAFIKQRAAKYANSNPQPIPGQPGMPQGQPGLQPPTMPGQQGVHSNPAMQNMNPMQAGVQRAGLPQQQPQQQLQPPMGGMSPQAQQMNMNHNTMPSQFRDILRRQQMMQQQQQQGAGPGIGPGMANHNQFQQPQGVGYPPQQQQRMQHHMQQMQQGNMGQIGQLPQALGAEAGASLQAYQQRLLQQQMGSPVQPNPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 853164 - protein, 1450 aa, Homo sapiens; identical to SEQ ID NO: 853150

SEQ ID NO: 853165 - protein, 1154 aa, Homo sapiens
QAIAEKQPSQEVKMEAKMEVDQPEPADTQPEDISESKVEDCKMESTETEERSTELKTEIKEEEDQPSTSATQSSPAPGQSKKKIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDRFVYTCNECKHHVETRWHCTVCEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTSQPQPTPPNSMPPYLPRTQAAGPVSQGKAAGQVTPPTPPQTAQPPLPGPPPAAVEMAMQIQRAAETQRQMAHVQIFQRPIQHQMPPMTPMAPMGMNPPPMTRGPSGHLEPGMGPTGMQQQPPWSQGGLPQPQQLQSGMPRPAMMSVAQHGQPLNMAPQPGLGQVGISPLKPGTVSQQALQNLLRTLRSPSSPLQQQQVLSILHANPQLLAAFIKQRAAKYANTANLPCAASWESSIPSDLASSSGS

SEQ ID NO: 853166 - protein, 305 aa, Homo sapiens
QAIAEKQPSQEVKMEAKMEVDQPEPADTQPEDISESKVEDCKMESTETEERSTELKTEIKEEEDQPSTSATQSSPAPGQSKKKIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAG

SEQ ID NO: 853167 - protein, 146 aa, Homo sapiens; identical to SEQ ID NO: 853159

SEQ ID NO: 853168 - protein, 146 aa, Homo sapiens; identical to SEQ ID NO: 853159

SEQ ID NO: 853169 - protein, 37 aa, Homo sapiens
PGLEVSGRRNLREILGTRVEVVVHMDTDDTDVCVTQK

SEQ ID NO: 853170 - protein, 496 aa, Homo sapiens
LWGHSASATLPGSRPSPAWCAARQLFARAGPPAAGSGQTMRPPSPLPARWLCVLAGALAWALGPAGGQAARLQEECDYVQMIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 853171 - protein, 461 aa, Homo sapiens
ALGPQRQRHSARLPAIARLVRRPPALCPRGAARRGLRADHAPAKSAARPLAMRAGRRPRLGPWAGGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 853172 - protein, 277 aa, Homo sapiens
ALGPQRQRHSARLPAIARLVRRPPALCPRGAARRGLRADHAPAKSAARPLAMRAGRRPRLGPWAGGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGGTQHIHHGVDHRQDPF

SEQ ID NO: 853173 - protein, 239 aa, Homo sapiens
MVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 853174 - protein, 239 aa, Homo sapiens; identical to SEQ ID NO: 853173

SEQ ID NO: 853175 - protein, 516 aa, Homo sapiens
RSLRRVVVVVVVALARLTHASSSSALAQAPRWRLVGGYAAGGRGGRGSLSGRPGRISRRRRRRPRWGRAAEAARASCCALALGLLGGQAARLQEECDYVQMIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 853176 - protein, 312 aa, Homo sapiens
LWGHSASATLPGSRPSPAWCAARQLFARAGPPAAGSGQTMRPPSPLPARWLCVLAGALAWALGPAGGQAARLQEECDYVQMIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGGTQHIHHGVDHRQDPF

SEQ ID NO: 853177 - protein, 187 aa, Homo sapiens [sequence omitted]

SEQ ID NO: 853178 - protein, 312 aa, Homo sapiens; identical to SEQ ID NO: 853176

SEQ ID NO: 853179 - protein, 383 aa, Homo sapiens
PGSSEPLTSASRVAGTTDLSLDYASQPANLQFPHIMPLAEDIKGSCFQSGNKRNHEPFIAPERFGNSSVGFGSNSHSQAPEKVTLLVDGTRFVVNPQIFTAHPDTMLGRMFGPGREYNFTRPNEKGEYEIAEGISATVFRTVLDYYKTGIINCPDGISIPDLRDTCDYLCINFDFNTIRCQDLSALLHELSNDGAHKQFDHYLEELILPIMVGCAKKGERECHIVVLTDEDSVDWDEDHPPPMGEEYSQILYSSKLYRFFKYIENRDVAKTVLKERGLKNIRIGIEGYPTCKEKIKRRPGGRSEVIYNYVQRPFIQMSWEKEEGKSRHVDFQCVRSKSLTNLVAAGDDVLEDQEILMHHPPQVDELDRLNAPLSQMASNDFQD

SEQ ID NO: 853180 - protein, 419 aa, Homo sapiens
MNVHRGSDSDRLLRQEASCLVDDTLAVAQEKEANSLASSGPHNLTYPLGPRNEDLSLDYASQPANLQFPHIMPLAEDIKGSCFQSGNKRNHEPFIAPERFGNSSVGFGSNSHSQAPEKVTLLVDGTRFVVNPQIFTAHPDTMLGRMFGPGREYNFTRPNEKGEYEIAEGISATVFRTVLDYYKTGIINCPDGISIPDLRDTCDYLCINFDFNTIRCQDLSALLHELSNDGAHKQFDHYLEELILPIMVGCAKKGERECHIVVLTDEDSVDWDEDHPPPMGEEYSQILYSSKLYRFFKYIENRDVAKTVLKERGLKNIRIGIEGYPTCKEKIKRRPGGRSEVIYNYVQRPFIQMSWEKEEGKSRHVDFQCVRSKSLTNLVAAGDDVLEDQEILMHHPPQVDELDRLNAPLSQMASNDFQD

SEQ ID NO: 853181 - protein, 375 aa, Homo sapiens
MNVHRGSDSDRLLRQEASCLVDDTLAVAQEKEANSLASSGPHNLTYPLGPRNEERFGNSSVGFGSNSHSQAPEKVTLLVDGTRFVVNPQIFTAHPDTMLGRMFGPGREYNFTRPNEKGEYEIAEGISATVFRTVLDYYKTGIINCPDGISIPDLRDTCDYLCINFDFNTIRCQDLSALLHELSNDGAHKQFDHYLEELILPIMVGCAKKGERECHIVVLTDEDSVDWDEDHPPPMGEEYSQILYSSKLYRFFKYIENRDVAKTVLKERGLKNIRIGIEGYPTCKEKIKRRPGGRSEVIYNYVQRPFIQMSWEKEEGKSRHVDFQCVRSKSLTNLVAAGDDVLEDQEILMHHPPQVDELDRLNAPLSQMASNDFQD

SEQ ID NO: 853182 - protein, 253 aa, Homo sapiens
MNVHRGSDSDRLLRQEASCLVDDTLAVAQEKEANSLASSGPHNLTYPLGPRNEGALLHELSNDGAHKQFDHYLEELILPIMVGCAKKGERECHIVVLTDEDSVDWDEDHPPPMGEEYSQILYSSKLYRFFKYIENRDVAKTVLKERGLKNIRIGIEGYPTCKEKIKRRPGGRSEVIYNYVQRPFIQMSWEKEEGKSRHVDFQCVRSKSLTNLVAAGDDVLEDQEILMHHPPQVDELDRLNAPLSQMASNDFQD

SEQ ID NO: 853183 - protein, 383 aa, Homo sapiens; identical to SEQ ID NO: 853179

SEQ ID NO: 853184 - protein, 383 aa, Homo sapiens; identical to SEQ ID NO: 853179

SEQ ID NO: 853185 - protein, 173 aa, Homo sapiens
MVGCAKKGERECHIVVLTDEDSVDWDEDHPPPMGEEYSQILYSSKLYRFFKYIENRDVAKTVLKERGLKNIRIGIEGYPTCKEKIKRRPGGRSEVIYNYVQRPFIQMSWEKEEGKSRHVDFQCVRSKSLTNLVAAGDDVLEDQEILMHHPPQVDELDRLNAPLSQMASNDFQD

SEQ ID NO: 853186 - protein, 383 aa, Homo sapiens; identical to SEQ ID NO: 853179

SEQ ID NO: 853187 - protein, 197 aa, Homo sapiens [sequence omitted]

SEQ ID NO: 853188 - protein, 364 aa, Homo sapiens
MASRLLHRLRHALAGDGPGEAAASPEAEQFPESSELEDDDAEGLSSRLSGTLSFTSAEDDEDDEDEDDEEAGPDQLPLGDGTSGEDAERSPPPDGQWGSQLLARQLQDFWKKSRNTLAPQRLLFEVTSANVVKDPPSKYVLYTLAVIGPGPPDCQPAQISRRYSDFERLHRNLQRQFRGPMAAISFPRKRLRRNFTAETIARRSRAFEQFLGHLQAVPELRHAPDLQDFFVLPELRRAQSLTCTGLYREALALWANAWQLQAQLGTPSGPDRPLLTLAGLAVCHQELEDPGEARACCEKALQLLGDKSLHPLLAPFLEAHVRLSWRLGLDKRQSEARLQALQEAGLTPTPPPSLKELLIKEVLD

SEQ ID NO: 853189 - protein, 364 aa, Homo sapiens; identical to SEQ ID NO: 853188

SEQ ID NO: 853190 - protein, 364 aa, Homo sapiens; identical to SEQ ID NO: 853188

SEQ ID NO: 853191 - protein, 396 aa, Homo sapiens
GYKQAVADPDPRTGDSCWGAARPGARAYPGTRRCMAPLCRLRHALAGDGPGEAAASPEAEQFPESSELEDDDAEGLSSRLSGTLSFTSAEDDEDDEDEDDEEAGPDQLPLGDGTSGEDAERSPPPDGQWGSQLLARQLQDFWKKSRNTLAPQRLLFEVTSANVVKDPPSKYGLYTLAVIGPGPPDCQPAQISRRYSDFERLHRNLQRQFRGPMAAISFPRKRLRRNFTAETIARRSRAFEQFLGHLQAVPELRHAPDLQDFFVLPELRRAQSLTCTGLYREALALWANAWQLQAQLGTPSGPDRPLLTLAGLAVCHQELEDPGEARACCEKALQLLGDKSLHPLLAPFLEAHVRLSWRLGLDKRQSEARLQALQEAGLTPTPPPSLKELLIKEVLD

SEQ ID NO: 853192 - protein, 244 aa, Homo sapiens
MGRERARGQLAFALTPTLPVLYTLAVIGPGPPDCQPAQISRRYSDFERLHRNLQRQFRGPMAAISFPRKRLRRNFTAETIARRSRAFEQFLGHLQAVPELRHAPDLQDFFVLPELRRAQSLTCTGLYREALALWANAWQLQAQLGTPSGPDRPLLTLAGLAVCHQELEDPGEARACCEKALQLLGDKSLHPLLAPFLEAHVRLSWRLGLDKRQSEARLQALQEAGLTPTPPPSLKELLIKEVLD

SEQ ID NO: 853193 - protein, 317 aa, Homo sapiens
MASRLLHRLRHALAGDGPGEAAASPEAEQFPESSELEDDDAEGLSSRLSGTLSFTSAEDDEDDEDEDDEEAGPDQLPLGDGTSGEDAERSPPPDGQWGSQLLARQLQDFWKKSRNTLAPQRLLFEVTSANVVKDPPSKYVLYTLAVIGPGPPDCQPAQISRRYSDFERLHRNLQRQFRGPMAAISFPRKRLRRNFTAETIARRSRAFEQFLGHLQAVPELRHAPDLQDFFVLPELRRAQSLTCTGLYREALALWANAWQLQAQLGTPSGPDRPLLTLAGLAVCHQELEDPGEAGVEKLFWGSPWGLWAWVGGANRGT

SEQ ID NO: 853194 - protein, 110 aa, Homo sapiens
MHRGTQEGAMASRLLHRLRHALAGDGPGEAAASPEAEQFPESSELEDDDAEGLSSRLSGTLSFTSAEDDEDDEDEDDEEAGPDQLPLGDGTSGEDAGECRRTEAGTLGLD

SEQ ID NO: 853195 - protein, 441 aa, Homo sapiens
MASRLLHRLRHALAGDGPGEAAASPEAEQFPESSELEDDDAEGLSSRLSGTLSFTSAEDDEDDEDEDDEEAGPDQLPLGDGTSGEDAERSPPPDGQWGSQLLARQLQDFWKKSRNTLAPQRLLFEVTSANVVKDPPSKYVRQGLAMLPRLVSNSWPEAVLLPQPPKVLGLQRGLSEELMLYGKGVQKKGQQPRALKLISVFLSSCCLGPGSFQTNLRLYTLAVIGPGPPDCQPAQISRRYSDFERLHRNLQRQFRGPMAAISFPRKRLRRNFTAETIARRSRAFEQFLGHLQAVPELRHAPDLQDFFVLPELRRAQSLTCTGLYREALALWANAWQLQAQLGTPSGPDRPLLTLAGLAVCHQELEDPGEARACCEKALQLLGDKSLHPLLAPFLEAHVRLSWRLGLDKRQSEARLQALQEAGLTPTPPPSLKELLIKEVLD

SEQ ID NO: 853196 - protein, 146 aa, Homo sapiens
MASRLLHRLRHALAGDGPGEAAASPEAEQFPESSELEDDDAEGLSSRLSGTLSFTSAEDDEDDEDEDDEEAGPDQLPLGDGTSGEDAERSPPPDGQWGSQLLARQLQDFWKKSRNTLAPQRLLFEVTSANVVKDPPSKYVCSTPSP

SEQ ID NO: 853197 - protein, 506 aa, Homo sapiens
EAGLAAGSCPERRSERPEPGGALQNPADLHGLRGAAPGPLGRGAPLNAPWDAGGRGARGGARDIGRVLSPSGEERGPRLSGLGGKRCWLGPLVRKTSDCQGVGPHRAPPSPVRAPPLLLLRRAGVPLLRDPVHSVARSPQGAMASRLLHRLRHALAGDGPGEAAASPEAEQFPESSELEDDDAEGLSSRLSGTLSFTSAEDDEDDEDEDDEEAGPDQLPLGDGTSGEDAERSPPPDGQWGSQLLARQLQDFWKKSRNTLAPQRLLFEVTSANVVKDPPSKYVLYTLAVIGPGPPDCQPAQISRRYSDFERLHRNLQRQFRGPMAAISFPRKRLRRNFTAETIARRSRAFEQFLGHLQAVPELRHAPDLQDFFVLPELRRAQSLTCTGLYREALALWANAWQLQAQLGTPSGPDRPLLTLAGLAVCHQELEDPGEARACCEKALQLLGDKSLHPLLAPFLEAHVRLSWRLGLDKRQSEARLQALQEAGLTPTPPPSLKELLIKEVLD

SEQ ID NO: 853198 - protein, 184 aa, Homo sapiens
MAAISFPRKRLRRNFTAETIARRSRAFEQFLGHLQAVPELRHAPDLQDFFVLPELRRAQSLTCTGLYREALALWANAWQLQAQLGTPSGPDRPLLTLAGLAVCHQELEDPGEARACCEKALQLLGDKSLHPLLAPFLEAHVRLSWRLGLDKRQSEARLQALQEAGLTPTPPPSLKELLIKEVLD

SEQ ID NO: 853199 - protein, 317 aa, Homo sapiens; identical to SEQ ID NO: 853193

SEQ ID NO: 853200 - protein, 261 aa, Homo sapiens
TALSAFTAIPAVLAAPAMGLELFLDLVSQPSRAVYIFAKKNGIPLELRTVDLVKGQHKSKEFLQINSLGKLPTLKDGDFILTESSAILIYLSCKYQTPDHWYPSDLQARARVHEYLGWHADCIRGTFGIPLWVQVLGPLIGVQVPEEKVERNRTAMDQALQWLEDKFLGDRPFLAGQQVTLADLMALEELMQPVALGYELFEGRPRLAAWRGRVEAFLGAELCQEAHSIILSILEQAAKKTLPTPSPEAYQAMLLRIARIP

SEQ ID NO: 853201 - protein, 195 aa, Homo sapiens
MRFSKCKAEGPAKSRCPSSAILIYLSCKYQTPDHWYPSDLQARARVHEYLGWHADCIRGTFGIPLWVQVLGPLIGVQVPEEKVERNRTAMDQALQWLEDKFLGDRPFLAGQQVTLADLMALEELMQPVALGYELFEGRPRLAAWRGRVEAFLGAELCQEAHSIILSILEQAAKKTLPTPSPEAYQAMLLRIARIP

SEQ ID NO: 853202 - protein, 295 aa, Homo sapiens
TALSAFTAIPAVLAAPAMGLELFLDLVSQPSRAVYIFAKKNGIPLELRTVDLVKGQHKSKEFLQINSLGKLPTLKDGDFILTERLTGVSTSQGGCWHITEMRFSKCKAEGPAKSRCPSSAILIYLSCKYQTPDHWYPSDLQARARVHEYLGWHADCIRGTFGIPLWVQVLGPLIGVQVPEEKVERNRTAMDQALQWLEDKFLGDRPFLAGQQVTLADLMALEELMQPVALGYELFEGRPRLAAWRGRVEAFLGAELCQEAHSIILSILEQAAKKTLPTPSPEAYQAMLLRIARIP

SEQ ID NO: 853203 - protein, 261 aa, Homo sapiens; identical to SEQ ID NO: 853200

SEQ ID NO: 853204 - protein, 322 aa, Homo sapiens
TALSAFTAIPAVLAAPAMGLELFLDLVSQPSRAVYIFAKKNGIPLELRTVDLVKGQHKSKEFLQINSLGKLPTLKDGDFILTESSAILIYLSCKYQTPDHWYPSDLQARARVHEYLGWHADCIRGTFGIPLWVQVLGPLIGVQVPEEKVERNRTAMDQALQWLEDKFLGDRPFLAGQQVTLADLMALEELMQPVALGYELFEGRPRLAAWRGRVEAFLGAELCQEAHSIILSILEQAAKKPGSPEGSGMGARRLATRIHSVTYLPLFIFPSCPSPFSPASCEALHRQDTQCPWQCCYSSGAAYITSKRLNLQYIKSSYKSVT

SEQ ID NO: 853205 - protein, 160 aa, Homo sapiens
TALSAFTAIPAVLAAPAMGLELFLDLVSQPSRAVYIFAKKNGIPLELRTVDLVKGQHKSKEFLQINSLGKLPTLKDGDFILTERCPPSLTPHRIRSPCDLGSPHWPRAPVALPYPMGQRGRGKARDLAGRGGSRLSSRHFGRPRRADHEVRRPRPSWLTP

SEQ ID NO: 853206 - protein, 155 aa, Homo sapiens
IPPLWGGGVLGLFGKKKTFKIGAPPQGGEKGGPPKPKGQFPNSSGEGPKIPPLETQPSQHPHQRPIRLCCFESPGSPEGSGMGARRLATRIHSVTYLPLFIFPSCPSPFSPASCEALHRQDTQCPWQCCYSSGAAYITSKRLNLQYIKSSYKSVT

SEQ ID NO: 853207 - protein, 297 aa, Homo sapiens
TALSAFTAIPAVLAAPAMGLELFLDLVSQPSRAVYIFAKKNGIPLELRTVDLVKGQHKSKEFLQINSLGKLPTLKDGDFILTERALLAYHRDEVLKMQSRRSSQESVPKATKTGGDSLEDSAILIYLSCKYQTPDHWYPSDLQARARVHEYLGWHADCIRGTFGIPLWVQVLGPLIGVQVPEEKVERNRTAMDQALQWLEDKFLGDRPFLAGQQVTLADLMALEELMQPVALGYELFEGRPRLAAWRGRVEAFLGAELCQEAHSIILSILEQAAKKTLPTPSPEAYQAMLLRIARIP

SEQ ID NO: 853208 - protein, 108 aa, Homo sapiens
ASWNRRPRKPSQHPHQRPIRLCCFESPGSPEGSGMGARRLATRIHSVTYLPLFIFPSCPSPFSPASCEALHRQDTQCPWQCCYSSGAAYITSKRLNLQYIKSSYKSVT

SEQ ID NO: 853209 - protein, 340 aa, Homo sapiens
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCRLFDLRADQELLMYSHDNIICGITSVAFSRSGRLLLAGYDDFNCNIWDAMKGDRAGVLAGHDNRVSCLGVTDDGMAVATGSWDSFLKIWN

SEQ ID NO: 853210 - protein, 358 aa, Homo sapiens
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGGIPRAGDATCALWDIETGQQTVGFAGHSGDVMSLSLAPDGRTFVSGACDASIKLWDVRDSMCRQTFIGHESDINAVAFFPNGYAFTTGSDDATCRLFDLRADQELLMYSHDNIICGITSVAFSRSGRLLLAGYDDFNCNIWDAMKGDRAGVLAGHDNRVSCLGVTDDGMAVATGSWDSFLKIWN

SEQ ID NO: 853211 - protein, 105 aa, Homo sapiens
PPPPPRRKTAPPAHRQRPPPQSPTATGTFAGKRSPLAPQPQFPPGEPLFLRSPGAGLLGADVTPQTSAPFPSCPVAPKPGRGTGEPSPPTVRALPRTISEVFARP

SEQ ID NO: 853212 - protein, 340 aa, Homo sapiens; identical to SEQ ID NO: 853209

SEQ ID NO: 853213 - protein, 263 aa, Homo sapiens
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGQLKSRTSNAKLAFLPPTGNALQPTGPEPNANVPPSFPNP

SEQ ID NO: 853214 - protein, 172 aa, Homo sapiens
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLCFRFLDDTKSPALGQMCRDPLDHRST

SEQ ID NO: 853215 - protein, 589 aa, Homo sapiens
MDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 853216 - protein, 505 aa, Homo sapiens
MKRQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 853217 - protein, 587 aa, Homo sapiens
MMDLELPPPGLPSQQDMDLIDILWRQDIDLGVSREVFDFSQRRKEYELEKQKKLEKERQEQLREFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 853218 - protein, 174 aa, Homo sapiens
MTTYSGYLLSTHGPQLIMMDLELPPPGLPSQQDMDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVRYKITWLIEKLHHNYKITIYSM

SEQ ID NO: 853219 - protein, 612 aa, Homo sapiens
MMDLELPPPGLPSQQDMDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQYKLPSHQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 853220 - protein, 141 aa, Homo sapiens
MDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVRYKITWLIEKLHHNYKITIYSM

SEQ ID NO: 853221 - protein, 575 aa, Homo sapiens
MMDLELPPPGLPSQQDMDLIDILWRQDIDLGVSREVFDFSQRRKEYELEKQKKLEKERQEQLQKEQEKAFFAQLQLDEETGEFLPIQPAQHIQSETSGSANYSQVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 853222 - protein, 95 aa, Homo sapiens
RRGRTLAPPLWGGRRSGAGARRRVADYRVPGSPEEPPTQPPPPPPPPPEPPCPRRASAAGTGPPSGSPNTRSTAHHDGLGAAAAGTPVPAGHGFD

SEQ ID NO: 853223 - protein, 367 aa, Homo sapiens
MMDLELPPPGLPSQQDMDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNTLKAQRIPEFLSPGFPFNKSPGFPQNPGDLPLGNLL

SEQ ID NO: 853224 - protein, 605 aa, Homo sapiens
MMDLELPPPGLPSQQDMDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 853225 - protein, 235 aa, Homo sapiens
MMDLELPPPGLPSQQDMDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQALTMLPRLVSNSWTWDPSASASQSAGITGVSHCAWPW

SEQ ID NO: 853226 - protein, 622 aa, Homo sapiens
MTTYSGYLLSTHGPQLIMMDLELPPPGLPSQQDMDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 853227 - protein, 589 aa, Homo sapiens; identical to SEQ ID NO: 853215

SEQ ID NO: 853228 - protein, 605 aa, Homo sapiens; identical to SEQ ID NO: 853224

SEQ ID NO: 853229 - protein, 505 aa, Homo sapiens; identical to SEQ ID NO: 853216

SEQ ID NO: 853230 - protein, 587 aa, Homo sapiens
MMDLELPPPGLPSQQDMDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 853231 - protein, 605 aa, Homo sapiens; identical to SEQ ID NO: 853224

SEQ ID NO: 853232 - protein, 580 aa, Homo sapiens
MMDLELPPPGLPSQQDMDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRFSHLFPDIPGHIESPVFIATNQAQSPETSVAQVAPVDLDGMQQDIEQVWEELLSIPEFSVLILKMTSRLRPRRRGREF

SEQ ID NO: 853233 - protein, 126 aa, Homo sapiens
MTTYSGYLLSTHGPQLIMMDLELPPPGLPSQQDMDLIDILWRQDIDLGVSREVFDFSQRRKEYELEKQKKLEKERQEQLQKEQEKAFFAQLQLDEETGEFLPIQPAQHIQSETSGSANYSQCPHSQ

SEQ ID NO: 853234 - protein, 516 aa, Homo sapiens [sequence omitted]

SEQ ID NO: 853235 - protein, 516 aa, Homo sapiens [sequence omitted]

SEQ ID NO: 853236 - protein, 131 aa, Homo sapiens
GPPRPGFCPARADSRKSGSGSRGVTVTPRRINFQRLMLHEKATKKTKEKETRMALPQGCLTFKDVAIEFSLEEWKCLNPAQRALYRAVMLENYRNLESVGLTSKDSWYMRKKPGRGRGKQRRQEWFFLRVY

SEQ ID NO: 853237 - protein, 131 aa, Homo sapiens; identical to SEQ ID NO: 853236

SEQ ID NO: 853238 - protein, 266 aa, Homo sapiens
MHGRKDDAQKQPVKNQLGLNPQSHLPELQLFQAEGKIYKYDHMEKSVNSSSLVSPPQRISSTVKTHISHTYECNFVDSLFTQKEKANIGTEHYKCNERGKAFHQGLHFTIHQIIHTKETQFKCDICGKIFNKKSNLASHQRIHTGEKPYKCNECGKVFHNMSHLAQHRRIHTGEKPYKCNECGKVFNQISHLAQHQRIHTGEKPYKCNECGKVFHQISHLAQHRTIHTGEKPYECNKCGKVFSRNSYLVQHLIIHTGEKPYRCNVL

SEQ ID NO: 853239 - protein, 516 aa, Homo sapiens [sequence omitted]

SEQ ID NO: 853240 - protein, 266 aa, Homo sapiens; identical to SEQ ID NO: 853238

SEQ ID NO: 853241 - protein, 1402 aa, Homo sapiens
KGPEVDIEGPEGKLKGPKFKMPDVHFKSPQISMSDIDLNLKGPKIKGDMDISVPKLEGDLKGPKVDVKGPKVGIDTPDIDIHGPEGKLKGPKFKMPDLHLKAPKISMPEVDLNLKGPKVKGDMDISLPKVEGDLKGPEVDIKGPKVDIDVPDVDVQGPDWHLKMPKVKMPKFSMPGFKGEGPDVDVNLPKADIDVSGPKVDVDVPDVNIEGPDAKLKGPKFKMPEMSIKAPKISMPDIDLNLKGPKVKGDVDVTLPKVEGDLKGPEADIKGPKVDINTPDVDVHGPDWHLKMPKVKMPKFSMPGFKGEGPDVDVSLPKADIDVSGPKVDVDIPDVNIEGPDAKLKGPKFKMPEINIKAPKISIPDVDLDLKGPKVKGDFDVSVPKVEGTLKGPEVDLKGPRLDFEGPDAKLSGPSLKMPSLEISAPKVTAPDVDLHLKAPKIGFSGPKLEGGEVDLKGPKVEAPSLDVHMDSPDINIEGPDVKIPKFKKPKFGFGAKSPKADIKSPSLDVTVPEAELNLETPEISVGGKGKKSKFKMPKIHMSGPKIKAKKQGFDLNVPGGEIDASLKAPDVDVNIAGPDAALKVDVKSPKTKKTMFGKMYFPDVEFDIKSPKFKAEAPLPSPKLEGELQAPDLELSLPAIHVEGLDIKAKAPKVKMPDVDISVPKIEGDLKGPKVQANLGAPDINIEGLDAKVKTPSFGISAPQVSIPDVNVNLKGPKIKGDVPSVGLEGPDVDLQGPEAKIKFPKFSMPKIGIPGVKMEGGGAEVHAQLPSLEGDLRGPDVKLEGPDVSLKGPGVDLPSVNLSMPKVSGPDLDLNLKGPSLKGDLDASVPSMKVHAPGLNLSGVGGKMQVGGDGVKVPGIDATTKLNVGAPDVTLRGPSLQGDLAVSGDIKCPKVSVGAPDLSLEASEGSIKLPKMKLPQFGISTPGSDLHVNAKGPQVSGELKGPGVDVNLKGPRISAPNVDFNLEGPKVKGSLGATGEIKGPTVGGGLPGIGVQGLEGNLQMPGIKSSGCDVNLPGVNVKLPTGQISGPEIKGGLKGSEVGFHGAAPDISVKGPAFNMASPESDFGINLKGPKIKGGADVSGGVSAPDISLGEGHLSVKGSGGEWKGPQVSSALNLDTSKFAGGLHFSGPKVEGGVKGGQIGLQAPGLSVSGPQGHLESGSGKVTFPKMKIPKFTFSGRELVGREMGVDVHFPKAEASIQAGAGDGEWEESEVKLKKSKIKMPKFNFSKPKGKGGVTGSPEASISGSKGDLKSSKASLGSLEGEAEAEASSPKGKFSLFKSKKPRHRSNSFSDEREFSGPSTPTGTLEFEGGEVSLEGGKVKGKHGKLKFGTFGGLGSKSKGHYEVTGSDDETGKLQGSGVSLASKKSRLSSSSSNDSGNKVGIQLPEVELSVSTKKE

SEQ ID NO: 853242 - protein, 1402 aa, Homo sapiens; identical to SEQ ID NO: 853241

SEQ ID NO: 853243 - protein, 1402 aa, Homo sapiens; identical to SEQ ID NO: 853241

SEQ ID NO: 853244 - protein, 1402 aa, Homo sapiens; identical to SEQ ID NO: 853241

SEQ ID NO: 853245 - protein, 790 aa, Homo sapiens
ADLEIPGKALPKLEGELQAPDLELSLPAIHVEGLDIKAKAPKVKMPDVDISVPKIEGDLKGPKVQANLGAPDINIEGLDAKVKTPSFGISAPQVSIPDVNVNLKGPKIKGDVPSVGLEGPDVDLQGPEAKIKFPKFSMPKIGIPGVKMEGGGAEVHAQLPSLEGDLRGPDVKLEGPDVSLKGPGVDLPSVNLSMPKVSGPDLDLNLKGPSLKGDLDASVPSMKVHAPGLNLSGVGGKMQVGGDGVKVPGIDATTKLNVGAPDVTLRGPSLQGDLAVSGDIKCPKVSVGAPDLSLEASEGSIKLPKMKLPQFGISTPGSDLHVNAKGPQVSGELKGPGVDVNLKGPRISAPNVDFNLEGPKVKGSLGATGEIKGPTVGGGLPGIGVQGLEGNLQMPGIKSSGCDVNLPGVNVKLPTGQISGPEIKGGLKGSEVGFHGAAPDISVKGPAFNMASPESDFGINLKGPKIKGGADVSGGVSAPDISLGEGHLSVKGSGGEWKGPQVSSALNLDTSKFAGGLHFSGPKVEGGVKGGQIGLQAPGLSVSGPQGHLESGSGKVTFPKMKIPKFTFSGRELVGREMGVDVHFPKAEASIQAGAGDGEWEESEVKLKKSKIKMPKFNFSKPKGKGGVTGSPEASISGSKGDLKSSKASLGSLEGEAEAEASSPKGKFSLFKSKKPRHRSNSFSDEREFSGPSTPTGTLEFEGGEVSLEGGKVKGKHGKLKFGTFGGLGSKSKGHYEVTGSDDETGKLQGSGVSLASKKSRLSSSSSNDSGNKVGIQLPEVELSVSTKKE

SEQ ID NO: 853246 - protein, 653 aa, Homo sapiens
MPKIGIPGVKMEGGGAEVHAQLPSLEGDLRGPDVKLEGPDVSLKGPGVDLPSVNLSMPKVSGPDLDLNLKGPSLKGDLDASVPSMKVHAPGLNLSGVGGKMQVGGDGVKVPGIDATTKLNVGAPDVTLRGPSLQGDLAVSGDIKCPKVSVGAPDLSLEASEGSIKLPKMKLPQFGISTPGSDLHVNAKGPQVSGELKGPGVDVNLKGPRISAPNVDFNLEGPKVKGSLGATGEIKGPTVGGGLPGIGVQGLEGNLQMPGIKSSGCDVNLPGVNVKLPTGQISGPEIKGGLKGSEVGFHGAAPDISVKGPAFNMASPESDFGINLKGPKIKGGADVSGGVSAPDISLGEGHLSVKGSGGEWKGPQVSSALNLDTSKFAGGLHFSGPKVEGGVKGGQIGLQAPGLSVSGPQGHLESGSGKVTFPKMKIPKFTFSGRELVGREMGVDVHFPKAEASIQAGAGDGEWEESEVKLKKSKIKMPKFNFSKPKGKGGVTGSPEASISGSKGDLKSSKASLGSLEGEAEAEASSPKGKFSLFKSKKPRHRSNSFSDEREFSGPSTPTGTLEFEGGEVSLEGGKVKGKHGKLKFGTFGGLGSKSKGHYEVTGSDDETGKLQGSGVSLASKKSRLSSSSSNDSGNKVGIQLPEVELSVSTKKE

SEQ ID NO: 853247 - protein, 389 aa, Homo sapiens
EWKGPQVSSALNLDTSKFAGGLHFSGPKVEGGVKGGQIGLQAPGKGCLGLSLHQIVGINLKGPKIKGGADVSGGVSAPDISLGEGHLSVKGSGGEWKGPQVSSALNLDTSKFAGGLHFSGPKVEGGVKGGQIGLQAPGLSVSGPQGHLESGSGKVTFPKMKIPKFTFSGRELVGREMGVDVHFPKAEASIQAGAGDGEWEESEVKLKKSKIKMPKFNFSKPKGKGGVTGSPEASISGSKGDLKSSKASLGSLEGEAEAEASSPKGKFSLFKSKKPRHRSNSFSDEREFSGPSTPTGTLEFEGGEVSLEGGKVKGKHGKLKFGTFGGLGSKSKGHYEVTGSDDETGKLQGSGVSLASKKSRLSSSSSNDSGNKVGIQLPEVELSVSTKKE

SEQ ID NO: 853248 - protein, 1402 aa, Homo sapiens; identical to SEQ ID NO: 853241

SEQ ID NO: 853249 - protein, 1402 aa, Homo sapiens; identical to SEQ ID NO: 853241

SEQ ID NO: 853250 - protein, 1402 aa, Homo sapiens; identical to SEQ ID NO: 853241

SEQ ID NO: 853251 - protein, 412 aa, Homo sapiens
KLRCVQVESRGDLGSFHSPPEPLTLKCPSPRSALGRFISISGPEIKGGLKGSEVGFHGAAPDISVKGPAFNMASPESDFGINLKGPKIKGGADVSGGVSAPDISLGEGHLSVKGSGGEWKGPQVSSALNLDTSKFAGGLHFSGPKVEGGVKGGQIGLQAPGLSVSGPQGHLESGSGKVTFPKMKIPKFTFSGRELVGREMGVDVHFPKAEASIQAGAGDGEWEESEVKLKKSKIKMPKFNFSKPKGKGGVTGSPEASISGSKGDLKSSKASLGSLEGEAEAEASSPKGKFSLFKSKKPRHRSNSFSDEREFSGPSTPTGTLEFEGGEVSLEGGKVKGKHGKLKFGTFGGLGSKSKGHYEVTGSDDETGKLQGSGVSLASKKSRLSSSSSNDSGNKVGIQLPEVELSVSTKKE

SEQ ID NO: 853252 - protein, 1402 aa, Homo sapiens; identical to SEQ ID NO: 853241

SEQ ID NO: 853253 - protein, 287 aa, Homo sapiens
MWGITAMWGIRGGLHFSGPKVEGGVKGGQIGLQAPGLSVSGPQGHLESGSGKVTFPKMKIPKFTFSGRELVGREMGVDVHFPKAEASIQAGAGDGEWEESEVKLKKSKIKMPKFNFSKPKGKGGVTGSPEASISGSKGDLKSSKASLGSLEGEAEAEASSPKGKFSLFKSKKPRHRSNSFSDEREFSGPSTPTGTLEFEGGEVSLEGGKVKGKHGKLKFGTFGGLGSKSKGHYEVTGSDDETGKLQGSGVSLASKKSRLSSSSSNDSGNKVGIQLPEVELSVSTKKE

SEQ ID NO: 853254 - protein, 104 aa, Homo sapiens
MTWRVVAHSSTVSILSAIAGDCQDETCCHRGSHELSHTWNPSDTHTYHNEPQNPVQKLRRRESQGQDNCLQPAALLGEDASRPPFWPFSPHPFPHPRLHPNPPW

SEQ ID NO: 853255 - protein, 93 aa, Homo sapiens
WLVWISAFYYQVLIHGFTQSLLLDDAGSVLATATSWDELEIQEEAESGSSVTSKIRLPAQVSRDHGLKKGINCSVEKKKDFRKSFNIQLLRNS

SEQ ID NO: 853256 - protein, 962 aa, Homo sapiens [sequence omitted]

SEQ ID NO: 853257 - protein, 962 aa, Homo sapiens [sequence omitted]

SEQ ID NO: 853258 - protein, 962 aa, Homo sapiens [sequence omitted]

SEQ ID NO: 853259 - protein, 797 aa, Homo sapiens
MATAATSPALKRLDLRDPAALFETHGAEEIRGLERQVRAEIEHKKEELRQMVGERYRDLIEAADTIGQMRRCAVGLVDAVKATDQYCARLRQAGSAAPRPPRAQQPQQPSQEKFYSMAAQIKLLLEIPEKIWSSMEASQCLHATQLYLLCCHLHSLLQLDSSSSRYSPVLSRFPILIRQVAAASHFRSTILHESKMLLKCQGVSDQAVAEALCSIMLLEESSPRQALTDFLLARKATIQKLLNQPHHGAGIKAQICSLVELLATTLKQAHALFYTLPEGLLPDPALPCGLLFSTLETITGQHPAGKGTGVLQEEMKLCSWFKHLPASIVEFQPTLRTLAHPISQEYLKDTLQKWIHMCNEDIKNGITNLLMYVKSMKGLAGIRDAMWELLTSESTNHSWDVLCRRLLEKPLLFWEDMMQQLFLDRLQTLTKEGFDSISSSSKELLVSALQELESSTSNSPSNKHIHFEYNMSLFLWSESPNDLPSDAAWVSVANRGQFASSGLSMKAQAISPCVQNFCSALDSKLKVKLDDLLAYLPSDDSSLPKDVSPTQAKSSAFDRYADAGTVQEMLRTQSVACIKHIVDCIRAELQSIEEGVQGQQDALNSAKLHSVLFMARLCQSLGELCPHLKQCILGKSESSEKPAREFRALRKQGKVKTQEIIPTQAKWQEVKEVLLQQSVMGYQVWSSAVVKVLIHGFTQSLLLDDAGSVLATATSWDELEIQEEAESGSSVTSKIRLPAQPSWYVQSFLFSLCQEINRVGGHALPKVTLQEMLKSCMVQVVAAYEKLSEEKQIKVGV

SEQ ID NO: 853260 - protein, 995 aa, Homo sapiens
WSRCYLVTRAGLLLYVTRAAAYPALKRLDLRDPAALFETHGAEEIRGLERQVRAEIEHKKEELRQMVGERYRDLIEAADTIGQMRRCAVGLVDAVKATDQYCARLRQAGSAAPRPPRAQQPQQPSQEKFYSMAAQIKLLLEIPEKIWSSMEASQCLHATQLYLLCCHLHSLLQLDSSSSRYSPVLSRFPILIRQVAAASHFRSTILHESKMLLKCQGVSDQAVAEALCSIMLLEESSPRQALTDFLLARKATIQKLLNQPHHGAGIKAQICSLVELLATTLKQAHALFYTLPEGLLPDPALPCGLLFSTLETITGQHPAGKGTGVLQEEMKLCSWFKHLPASIVEFQPTLRTLAHPISQEYLKDTLQKWIHMCNEDIKNGITNLLMYVKSMKGLAGIRDAMWELLTSESTNHSWDVLCRRLLEKPLLFWEDMMQQLFLDRLQTLTKEGFDSISSSSKELLVSALQELESSTSNSPSNKHIHFEYNMSLFLWSESPNDLPSDAAWVSVANRGQFASSGLSMKAQAISPCVQNFCSALDSKLKVKLDDLLAYLPSDDSSLPKDVSPTQAKSSAFDRYADAGTVQEMLRTQSVACIKHIVDCIRAELQSIEEGVQGQQDALNSAKLHSVLFMARLCQSLGELCPHLKQCILGKSESSEKPAREFRALRKQGKVKTQEIIPTQAKWQEVKEVLLQQSVMGYQVWSSAVVKVLIHGFTQSLLLDDAGSVLATATSWDELEIQEEAESGSSVTSKIRLPAQPSWYVQSFLFSLCQEINRVGGHALPKVTLQEMLKSCMVQVVAAYEKLSEEKQIKKEGAFPVTQNRALQLLYDLRYLNIVLTAKGDEVKSGRSKPDSRIEKVTDHLEALIDPFDLDVFTPHLNSNLHRLVQRTSVLFGLVTGTENQLAPRSSTFNSQEPHNILPLASSQIRFGLLPLSMTSTRKAKSTRNIETKAQVVPPARSTAGDPTVPGSLFRQLVSEEDNTSAPSLFKLGWLSSMTK

SEQ ID NO: 853261 - protein, 940 aa, Homo sapiens
MATAATSPALKRLDLRDPAALFETHGAEEIRGLERQVRAEIEHKKEELRQMVGERYRDLIEAADTIGQMRRCAVGLVDAVKATDQYCARLRQAGSAAPRPPRAQQPQQPSQEKFYSMAAQIKLLLEIPEKIWSSMEASQCLHATQLYLLCCHLHSLLQLDSSSSRYSPVLSRFPILIRQVAAASHFRSTILHESKMLLKCQGVSDQAVAEALCSIMLLEESSPRQALTDFLLARKATIQKLLNQPHHGAGIKAQICSLVELLATTLKQAHALFYTLPEGLLPDPALPCGLLFSTLETITGQHPAGKGTGVLQEEMKLCSWFKHLPASIVEFQPTLRTLAHPISQEYLKDTLQKWIHMCNEDIKNGITNLLMYVKSMKGLAGIRDAMWELLTSESTNHSWDVLCRRLLEKPLLFWEDMMQQLFLDRLQTLTKEGFDSISSSSKELLVSALQELESSTSNSPSNKHIHFEYNMSLFLWSESPNDLPSDAAWVSVANRGQFASSGLSMKAQAISPCVQNFCSALDSKLKVKLDDLLAYLPSDDSSLPKDVSPTQAKSSAFDRYADAGTVQEMLRTQSVACIKHIVDCIRAELQSIEEGVQGQQDALNSAKLHSVLFMARLCQSLGELCPHLKQCILGKSESSEKPAREFRALRKQGKVKTQEIIPTQAKWQEVKEVLLQQSVMGYQVWSSAVVKVLIHGFTQSLLLDDAGSVLATATSWDELEIQEEAESGSSVTSKIRLPAQPSWYVQSFLFSLCQEINRVGGHALPKVTLQEMLKSCMVQVVAAYEKLSEEKQIKKEGAFPVTQNRALQLLYDLRYLNIVLTAKGDEVKSGRSKPDSRIEKVTDHLEALIDPFDLDVFTPHLNSNLHRLVQRTSVLFGLVTGTENQLAPRSSTFNSQEPHNILPLASSQIRFGLLPLSMTSTRKAKSTRNIETKAQYDANC

SEQ ID NO: 853262 - protein, 940 aa, Homo sapiens; identical to SEQ ID NO: 853261

SEQ ID NO: 853263 - protein, 797 aa, Homo sapiens; identical to SEQ ID NO: 853259

SEQ ID NO: 853264 - protein, 797 aa, Homo sapiens; identical to SEQ ID NO: 853259

SEQ ID NO: 853265 - protein, 89 aa, Homo sapiens
VARSKVCRPRVGMASVRSRFGLLPLSMTSTRKAKSTRNIETKAQVVPPARSTAGDPTVPGSLFRQLVSEEDNTSAPSLFKLGWLSSMTK

SEQ ID NO: 853266 - protein, 962 aa, Homo sapiens [sequence omitted]

SEQ ID NO: 853267 - protein, 980 aa, Homo sapiens
MATAATSPALKRLDLRDPAALFETHGAEEIRGLERQVRAEIEHKKEELRQMVGERYRDLIEAADTIGQMRRCAVGLVDAVKATDQYCARLRQAGSAAPRPPRAQQPQQPSQEKFYSMAAQIKLLLEIPEKIWSSMEASQCLHATQLYLLCCHLHSLLQLDSSSSRYSPVLSRFPILIRQVAAASHFRSTILHESKMLLKCQGVSDQAVAEALCSIMLLEESSPRQALTDFLLARKATIQKLLNQPHHGAGIKAQICSLVELLATTLKQAHALFYTLPEGLLPDPALPCGLLFSTLETITGQHPAGKGTGVLQEEMKLCSWFKHLPASIVEFQPTLRTLAHPISQEYLKDTLQKWIHMCNEDIKNGITNLLMYVKSMKGLAGIRDAMWELLTSESTNHSWDVLCRRLLEKPLLFWEDMMQQLFLDRLQTLTKEGFDSISSSSKELLVSALQELESSTSNSPSNKHIHFEYNMSLFLWSESPNDLPSDAAWVSVANRGQFASSGLSMKAQAISPCVQNFCSALDSKLKVKLDDLLAYLPSDDSSLPKDVSPTQAKSSAFDRYADAGTVQEMLRTQSVACIKHIVDCIRAELQSIEEGVQGQQDALNSAKLHSVLFMARLCQSLGELCPHLKQCILGKSESSEKPAREFRALRKQGKVKTQEIIPTQAKWQEVKEVLLQQSVMGYQVWSSAVVKVLIHGFTQSLLLDDAGSVLATATSWDELEIQEEAESGSSVTSKIRLPAQPSWYVQSFLFSLCQEINRVGGHALPKVTLQEMLKSCMVQVVAAYEKLSEEKQIKKEGAFPVTQNRALQLLYDLRYLNIVLTAKGDEVKSGRSKPDSRIEKVTDHLEALIDPFDLDVFTPHLNSNLHRLVQRTSVLFGLVTGTENQLAPRSSTFNSQEPHNILPLASSQIRFGLLPLSMTSTRKAKSTRNIETKAQVVPPARSTAGDPTVPGSLFRQLVSEEDNTSAPSLFKLGWLSSMTK

SEQ ID NO: 853268 - protein, 841 aa, Homo sapiens
MATAATSPALKRLDLRDPAALFETHGAEEIRGLERQVRAEIEHKKEELRQMVGERYRDLIEAADTIGQMRRCAVGLVDAVKATDQYCARLRQAGSAAPRPPRAQQPQQPSQEKFYSMAAQIKLLLEIPEKIWSSMEASQCLHATQLYLLCCHLHSLLQLDSSSSRYSPVLSRFPILIRQVAAASHFRSTILHESKMLLKCQGVSDQAVAEALCSIMLLEESSPRQALTDFLLARKATIQKLLNQPHHGAGIKAQICSLVELLATTLKQAHALFYTLPEGLLPDPALPCGLLFSTLETITGQHPAGKGTGVLQEEMKLCSWFKHLPASIVEFQPTLRTLAHPISQEYLKDTLQKWIHMCNEDIKNGITNLLMYVKSMKGLAGIRDAMWELLTSESTNHSWDVLCRRLLEKPLLFWEDMMQQLFLDRLQTLTKEGFDSISSSSKELLVSALQELESSTSNSPSNKHIHFEYNMSLFLWSESPNDLPSDAAWVSVANRGQFASSGLSMKAQAISPCVQNFCSALDSKLKVKLDDLLAYLPSDDSSLPKDVSPTQAKSSAFDRYADAGTVQEMLRTQSVACIKHIVDCIRAELQSIEEGVQGQQDALNSAKLHSVLFMARLCQSLGELCPHLKQCILGKSESSEKPAREFRALRKQGKVKTQEIIPTQAKWQEVKEVLLQQSVMGYQVWSSAVVKVLIHGFTQSLLLDDAGSVLATATSWDELEIQEEAESGSSVTSKIRLPAQPSWYVQSFLFSLCQEINRVGGHALPKVTLQEMLKSCMVQVVAAYEKLSEEKQIKKEGAFPVTQNRALQLLYDLRYLNIVLTAKGDEVKSGRSKPDSRCRIL

SEQ ID NO: 853269 - protein, 987 aa, Homo sapiens
MATAATSPALKRLDLRDPAALFETHGAEEIRGLERQVRAEIEHKKEELRQMVGERYRDLIEAADTIGQMRRCAVGLVDAVKATDQYCARLRQAGSAAPRPPRAQQFCAFLLQPQQPSQEKFYSMAAQIKLLLEIPEKIWSSMEASQCLHATQLYLLCCHLHSLLQLDSSSSRYSPVLSRFPILIRQVAAASHFRSTILHESKMLLKCQGVSDQAVAEALCSIMLLEESSPRQALTDFLLARKATIQKLLNQPHHGAGIKAQICSLVELLATTLKQAHALFYTLPEGLLPDPALPCGLLFSTLETITGQHPAGKGTGVLQEEMKLCSWFKHLPASIVEFQPTLRTLAHPISQEYLKDTLQKWIHMCNEDIKNGITNLLMYVKSMKGLAGIRDAMWELLTSESTNHSWDVLCRRLLEKPLLFWEDMMQQLFLDRLQTLTKEGFDSISSSSKELLVSALQELESSTSNSPSNKHIHFEYNMSLFLWSESPNDLPSDAAWVSVANRGQFASSGLSMKAQAISPCVQNFCSALDSKLKVKLDDLLAYLPSDDSSLPKDVSPTQAKSSAFDRYADAGTVQEMLRTQSVACIKHIVDCIRAELQSIEEGVQGQQDALNSAKLHSVLFMARLCQSLGELCPHLKQCILGKSESSEKPAREFRALRKQGKVKTQEIIPTQAKWQEVKEVLLQQSVMGYQVWSSAVVKVLIHGFTQSLLLDDAGSVLATATSWDELEIQEEAESGSSVTSKIRLPAQPSWYVQSFLFSLCQEINRVGGHALPKVTLQEMLKSCMVQVVAAYEKLSEEKQIKKEGAFPVTQNRALQLLYDLRYLNIVLTAKGDEVKSGRSKPDSRIEKVTDHLEALIDPFDLDVFTPHLNSNLHRLVQRTSVLFGLVTGTENQLAPRSSTFNSQEPHNILPLASSQIRFGLLPLSMTSTRKAKSTRNIETKAQVVPPARSTAGDPTVPGSLFRQLVSEEDNTSAPSLFKLGWLSSMTK

SEQ ID NO: 853270 - protein, 864 aa, Homo sapiens [sequence omitted]

SEQ ID NO: 853271 - protein, 545 aa, Homo sapiens
MQQLFLDRLQTLTKEGFDSISSSSKELLVSALQELESSTSNSPSNKHIHFEYNMSLFLWSESPNDLPSDAAWVSVANRGQFASSGLSMKAQAISPCVQNFCSALDSKLKVKLDDLLAYLPSDDSSLPKDVSPTQAKSSAFDRYADAGTVQEMLRTQSVACIKHIVDCIRAELQSIEEGVQGQQDALNSAKLHSVLFMARLCQSLGELCPHLKQCILGKSESSEKPAREFRALRKQGKVKTQEIIPTQAKWQEVKEVLLQQSVMGYQVWSSAVVKVLIHGFTQSLLLDDAGSVLATATSWDELEIQEEAESGSSVTSKIRLPAQPSWYVQSFLFSLCQEINRVGGHALPKVTLQEMLKSCMVQVVAAYEKLSEEKQIKKEGAFPVTQNRALQLLYDLRYLNIVLTAKGDEVKSGRSKPDSRIEKVTDHLEALIDPFDLDVFTPHLNSNLHRLVQRTSVLFGLVTGTENQLAPRSSTFNSQEPHNILPLASSQIRFGLLPLSMTSTRKAKSTRNIETKAQVGAKSKRLIRGWVPTSHRATHDQLPFK

SEQ ID NO: 853272 - protein, 910 aa, Homo sapiens
MATAATSPALKRLDLRDPAALFETHGAEEIRGLERQVRAEIEHKKEELRQMVGERYRDLIEAADTIGQMRRCAVGLVDAVKATDQYCARLRQAGSAAPRPPRAQQPQQPSQEKFYSMAAQIKLLLEIPEKIWSSMEASQCLHATQLYLLCCHLHSLLQLDSSSSRYSPVLSRFPILIRQVAAASHFRSTILHESKMLLKCQGVSDQAVAEALCSIMLLEESSPRQALTDFLLARKATIQKLLNQPHHGAGIKAQICSLVELLATTLKQAHALFYTLPEGLLPDPALPCGLLFSTLETITGQHPAGKGTGVLQEEMKLCSWFKHLPASIVEFQPTLRTLAHPISQEYLKDTLQKWIHMCNEDIKNGITNLLMYVKSMKGLAGIRDAMWELLTSESTNHSWDVLCRRLLEKPLLFWEDMMQQLFLDRLQTLTKEGFDSISSSSKELLVSALQELESSTSNSPSNKHIHFEYNMSLFLWSESPNDLPSDAAWVSVANRGQFASSGLSMKAQAISPCVQNFCSALDSKLKVKLDDLLAYLPSDDSSLPKDVSPTQAKSSAFDRYADAGTVQEMLRTQSVACIKHIVDCIRAELQSIEEGVQGQQDALNSAKLHSVLFMARLCQSLGELCPHLKQCILGKSESSEKPAREFRALRKQGKVKTQEIIPTQAKWQEVKEVLLQQSVMGYQVWSSAVVKVLIHGFTQSLLLDDAGSVLATATSWDELEIQEEAESGSSVTSKIRLPAQPSWYVQSFLFSLCQEINRVGGHALPKVTLQEMLKSCMVQVVAAYEKLSEEKQIKKEGAFPVTQNRALQLLYDLRYLNIVLTAKGDEVKSGRSKPDSRIEKVTDHLEALIDPFDLDVFTPHLNSNLHRLVQRTSVLFGLVTGTENQLAPRSSTFNSQEPHNILPLASSQIR

SEQ ID NO: 853273 - protein, 841 aa, Homo sapiens; identical to SEQ ID NO: 853268

SEQ ID NO: 853274 - protein, 707 aa, Homo sapiens
MATAATSPALKRLDLRDPAALFETHGAEEIRGLERQVRAEIEHKKEELRQMVGERYRDLIEAADTIGQMRRCAVGLVDAVKATDQYCARLRQAGSAAPRPPRAQQPQQPSQEKFYSMAAQIKLLLEIPEKIWSSMEASQCLHATQLYLLCCHLHSLLQLDSSSSRYSPVLSRFPILIRQVAAASHFRSTILHESKMLLKCQGVSDQAVAEALCSIMLLEESSPRQALTDFLLARKATIQKLLNQPHHGAGIKAQICSLVELLATTLKQAHALFYTLPEGLLPDPALPCGLLFSTLETITGQHPAGKGTGVLQEEMKLCSWFKHLPASIVEFQPTLRTLAHPISQEYLKDTLQKWIHMCNEDIKNGITNLLMYVKSMKGLAGIRDAMWELLTSESTNHSWDVLCRRLLEKPLLFWEDMMQQLFLDRLQTLTKEGFDSISSSSKELLVSALQELESSTSNSPSNKHIHFEYNMSLFLWSESPNDLPSDAAWVSVANRGQFASSGLSMKAQAISPCVQNFCSALDSKLKVKLDDLLAYLPSDDSSLPKDVSPTQAKSSAFDRYADAGTVQEMLRTQSVACIKHIVDCIRAELQSIEEGVQGQQDALNSAKLHSVLFMARLCQSLGELCPHLKQCILGKSESSEKPAREFRALRKQGKVKTQEIIPTQAKWQEVKEVLLQQSVMGYQVWSSAVVKWIMDSPGLAQCPSRIG

SEQ ID NO: 853275 - protein, 77 aa, Homo sapiens
VSGSSAKSCSGGGQASHYGFMAFVFFPDVPKLFTQDVKNTLATSVIIFLGQLFCMKARCCSNAKVCLTKLWPRPCAL

SEQ ID NO: 853276 - protein, 351 aa, Homo sapiens
RVISSRPSGRGRGRRGCSGPPEPAAMAPAAASPPEVIRAAQKDEYYRGGLRSAAGGALHSLAGARKWLEWRKEVELLSDVAYFGLTTLAGYQTLGEEYVSIIQVDPSRIHVPSSLRRGVLVTLHAVLPYLLDKALLPLEQELQADPDSGRPLQGSLGPGGRGCSGARRWMRHHTATLTEQQRRALLRAVFVLRQGLACLQRLHVAWFYIHGVFYHLAKRLTGITYLRVRSLPGEDLRARVSYRLLGVISLLHLVLSMGLQLYGFRQRQRARKEWRLHRGLSHRRASLEERAVSRNPLCTLCLEERRHPTATPCGHLFCWECITAWCSSKAECPLCREKFPPQKLIYLRHYR

SEQ ID NO: 853277 - protein, 351 aa, Homo sapiens; identical to SEQ ID NO: 853276

SEQ ID NO: 853278 - protein, 351 aa, Homo sapiens; identical to SEQ ID NO: 853276

SEQ ID NO: 853279 - protein, 326 aa, Homo sapiens
MVVPCLPPAILQDSPGPSAALGAKKQGLLLHLPCSHSGARKWLEWRKEVELLSDVAYFGLTTLAGYQTLGEEYVSIIQVDPSRIHVPSSLRRGVLVTLHAVLPYLLDKALLPLEQELQADPDSGRPLQGSLGPGGRGCSGARRWMRHHTATLTEQQRRALLRAVFVLRQGLACLQRLHVAWFYIHGVFYHLAKRLTGITYLRVRSLPGEDLRARVSYRLLGVISLLHLVLSMGLQLYGFRQRQRARKEWRLHRGLSHRRASLEERAVSRNPLCTLCLEERRHPTATPCGHLFCWECITAWCSSKAECPLCREKFPPQKLIYLRHYR

SEQ ID NO: 853280 - protein, 182 aa, Homo sapiens
MRHHTATLTEQQRRALLRAVFVLRQGLACLQRLHVAWFYIHGVFYHLAKRLTGITYLRVRSLPGEDLRARVSYRLLGVISLLHLVLSMGLQLYGFRQRQRARKEWRLHRGLSHRRASLEERAVSRNPLCTLCLEERRHPTATPCGHLFCWECITAWCSSKAECPLCREKFPPQKLIYLRHYR

SEQ ID NO: 853281 - protein, 351 aa, Homo sapiens; identical to SEQ ID NO: 853276

SEQ ID NO: 853282 - protein, 351 aa, Homo sapiens; identical to SEQ ID NO: 853276

SEQ ID NO: 853283 - protein, 351 aa, Homo sapiens; identical to SEQ ID NO: 853276

SEQ ID NO: 853284 - protein, 351 aa, Homo sapiens; identical to SEQ ID NO: 853276

SEQ ID NO: 853285 - protein, 351 aa, Homo sapiens; identical to SEQ ID NO: 853276

SEQ ID NO: 853286 - protein, 110 aa, Homo sapiens
MPRGRVPHFPADVKHLASRTGFRQRPAQTMSCCLTYLGMRMTLYSWVSQGQLARDGGGRGGRDPLDWEDHQERHWGLRPGGQMPPWLHPSAPSPLLHCALAKRVRLPVTP

SEQ ID NO: 853287 - protein, 371 aa, Homo sapiens
RVISSRPSGRGRGRRGCSGPPEPAAMAPAAASPPEVIRAAQKDEYYRGGLRSAAGGALHSLAGARKWLEWRKEVELLSDVAYFGLTTLAGYQTLGEEYVSIIQVDPSRIHVPSSLRRGVLVTLHAVLPYLLDKALLPLEQELQADPDSGRPLQGSLGPGGRGCSGARRWMRHHTATLTEQQRRALLRAVFVLRQGLACLQRLHVAWFYIHGVFYHLAKRLTGITYQALRPDPLRVLMSVAPSALQLRVRSLPGEDLRARVSYRLLGVISLLHLVLSMGLQLYGFRQRQRARKEWRLHRGLSHRRASLEERAVSRNPLCTLCLEERRHPTATPCGHLFCWECITAWCSSKAECPLCREKFPPQKLIYLRHYR

SEQ ID NO: 853288 - protein, 139 aa, Homo sapiens
NLGKVEAGWLDHVLRVRSLPGEDLRARVSYRLLGVISLLHLVLSMGLQLYGFRQRQRARKEWRLHRGLSHRRASLEERAVSRNPLCTLCLEERRHPTATPCGHLFCWECITAWCSSKAECPLCREKFPPQKLIYLRHYR

SEQ ID NO: 853289 - protein, 351 aa, Homo sapiens; identical to SEQ ID NO: 853276

SEQ ID NO: 853290 - protein, 369 aa, Homo sapiens
RVISSRPSGRGRGRRGCSGPPEPAAMAPAAASPPEVIRAAQKDEYYRGGLRSAAGGALHSLAGARKWLEWRKEVELLSDVAYFGLTTLAGYQTLGEEYVSIIQVDPSRIHVPSSLRRGVLVTLHAVLPYLLDKALLPLEQELQADPDSGRPLQGSLGPGGRGCSGARRWMRHHTATLTEQQRRALLRAVFVLRQGLACLQRLHVAWFYIHGVFYHLAKRLTGITYQALRPDPLRVLMSVAPSALQLRVRSLPGEDLRARVSYRLLGVISLLHLVLSMGLQLYGFRQRQRARKEWRLHRGLSHRRASLEERAVSRNPLCTLCLEERRHPTATPCGHLFCWECITAWCSSKVRWEPAAVLGWSAAVPARCT

SEQ ID NO: 853291 - protein, 60 aa, Homo sapiens
MRSPPMKTAMTGVRPLTCDLSQAASWSVLLLPPWGWDSVSHTEPTTLPPSAWSLINRVFS

SEQ ID NO: 853292 - protein, 288 aa, Homo sapiens
MQKLTAEMPDQFEIAETVSRTDSPSKIIKLDTVRVIAEKDKHALLDVTPSAIERLNYVQYYPIVVFFIPESRPALKALRQWLAPASRRSTRRLYAQAQKLRKHSSHLFTATIPLNGTSDTWYQELKAIIREQQTRPIWTAEDQLDGSLEDNLDLPHHGLADSSADLSCDSRVNSDYETDGEGGAYTDGEGYTDGEGGPYTDVDDEPPAPALARSSEPVQADESQSPRDRGRISAHQGAQVDSRHPQGQWRQDSMRTYEREALKKKFTRVHDAESSDEDGYDWGPATDL

SEQ ID NO: 853293 - protein, 119 aa, Homo sapiens
MAVRFQVADMEELTIWEQHTATLSKDPRRGFGIAISGGRDRPGGSMVVSDVVPGGPAEGRLQTGDHIVMVNGVSMENATSAFAIQILKTCTKMANIVSRQPLAWPASLTPAWVVPLWGL

SEQ ID NO: 853294 - protein, 750 aa, Homo sapiens
VFHVLDTLHPGPGQSHARGGHWPVKSVLVKRRDSEEFGVKLGSQIFIKHITDSGLAARHRGLQEGDLILQINGVSSQNLSLNDTRRLIEKSEGKLSLLVLRDRGQFLVNIPPAVSDSDSSPLEDISDLASELSQAPPSHIPPPPRHAQRSPEASQTDSPVESPRLRRESSVDSRTISEPDEQRSELPRESSYDIYRVPSSQSMEDRGYSPDTRVVRFLKGKSIGLRLAGGNDVGIFVSGVQAGSPADGQGIQEGDQILQVNDVPFQNLTREEAVQFLLGLPPGEEMELVTQRKQDIFWKMVQSRVGDSFYIRTHFELEPSPPSGLGFTRGDVFHVLDTLHPGPGQSHARGGHWLAVRMGRDLREQERGIIPNQSRAEQLASLEAAQRAVGVGPGSSAGSNARAEFWRLRGLRRGAKKTTQRSREDLSALTRQGRYPPYERVVLREASFKRPVVILGPVADIAMQKLTAEMPDQFEIAETVSRTDSPSKIIKLDTVRVIAEKDKHALLDVTPSAIERLNYVQYYPIVVFFIPESRPALKALRQWLAPASRRSTRRLYAQAQKLRKHSSHLFTATIPLNGTSDTWYQELKAIIREQQTRPIWTAEDQLDGSLEDNLDLPHHGLADSSADLSCDSRVNSDYETDGEGGAYTDGEGYTDGEGGPYTDVDDEPPAPALARSSEPVQADESQSPRDRGRISAHQGAQVDSRHPQGQWRQDSMRTYEREALKKKFTRVHDAESSDEDGYDWGPATDL

SEQ ID NO: 853295 - protein, 928 aa, Homo sapiens [sequence omitted]

SEQ ID NO: 853296 - protein, 573 aa, Homo sapiens
PSPWSVSLCLWSSVPLAGDLPPCCHHKRGKVGQTGGEARATSLGFPPHHPCQAGTRALAPAACPEATQPPRQVADMEELTIWEQHTATLSKDPRRGFGIAISGGRDRPGGSMVVSDVVPGGPAEGRLQTGDHIVMVNGVSMENATSAFAIQILKTCTKMANITVKRPRRIHLPATKASPSSPGRQDSDEDDGPQRVEEVDQGRGYDGDSSSGSGRSWDERSRRPRPGRRGRAGSHGRRSPGGGSEANGLALVSGFKRLPRQDVQMKPVKSVLVKRRDSEEFGVKLGSQIFIKHITDSGLAARHRGLQEGDLILQINGVSSQNLSLNDTRRLIEKSEGKLSLLVLRDRGQFLVNIPPAVSDSDSSPLEDISDLASELSQAPPSHIPPPPRHAQRSPEASQTDSPVESPRLRRESSVDSRTISEPDEQRSLDGSLEDNLDLPHHGLADSSADLSCDSRVNSDYETDGEGGAYTDGEGYTDGEGGPYTDVDDEPPAPALARSSEPVQADESQSPRDRGRISAHQGAQVDSRHPQGQWRQDSMRTYEREALKKKFTRVHDAESSDEDGYDWGPATDL

SEQ ID NO: 853297 - protein, 952 aa, Homo sapiens
MNLCGLMPIFPAPLDQVADMEELTIWEQHTATLSKDPRRGFGIAISGGRDRPGGSMVVSDVVPGGPAEGRLQTGDHIVMVNGVSMENATSAFAIQILKTCTKMANITVKRPRRIHLPATKASPSSPGRQDSDEDDGPQRVEEVDQGRGYDGDSSSGSGRSWDERSRRPRPGRRGRAGSHGRRSPGGGSEANGLALVSGFKRLPRQDVQMKPVKSVLVKRRDSEEFGVKLGSQIFIKHITDSGLAARHRGLQEGDLILQINGVSSQNLSLNDTRRLIEKSEGKLSLLVLRDRGQFLVNIPPAVSDSDSSPLEEGVTMADEMSSPPADISDLASELSQAPPSHIPPPPRHAQRSPEASQTDSPVESPRLRRESSVDSRTISEPDEQRSELPRESSYDIYRVPSSQSMEDRGYSPDTRVVRFLKGKSIGLRLAGGNDVGIFVSGVQAGSPADGQGIQEGDQILQVNDVPFQNLTREEAVQFLLGLPPGEEMELVTQRKQDIFWKMVQSRVGDSFYIRTHFELEPSPPSGLGFTRGDVFHVLDTLHPGPGQSHARGGHWLAVRMGRDLREQERGIIPNQSRAEQLASLEAAQRAVGVGPGSSAGSNARAEFWRLRGLRRGAKKTTQRSREDLSALTRQGRYPPYERVVLREASFKRPVVILGPVADIAMQKLTAEMPDQFEIAETVSRTDSPSKIIKLDTVRVIAEKDKHALLDVTPSAIERLNYVQYYPIVVFFIPESRPALKALRQWLAPASRRSTRRLYAQAQKLRKHSSHLFTATIPLNGTSDTWYQELKAIIREQQTRPIWTAEDQLDGSLEDNLDLPHHGLADSSADLSCDSRVNSDYETDGEGGAYTDGEGYTDGEGGPYTDVDDEPPAPALARSSEPVQADESQSPRDRGRISAHQGAQVDSRHPQGQWRQDSMRTYEREALKKKFTRVHDAESSDEDGYDWGPATDL

SEQ ID NO: 853298 - protein, 94 aa, Homo sapiens
QTCHGVSNVGSMARAKVGDGMEVVIDLDSPCSGGSFEAPLSLSSKVDSRHPQGQWRQDSMRTYEREALKKKFTRVHDAESSDEDGYDWGPATDL

SEQ ID NO: 853299 - protein, 994 aa, Homo sapiens
PSPWSVSLCLWSSVPLAGDLPPCCHHKRGKVGQTGGEARATSLGFPPHHPCQAGTRALAPAACPEATQPPRQVADMEELTIWEQHTATLSKDPRRGFGIAISGGRDRPGGSMVVSDVVPGGPAEGRLQTGDHIVMVNGVSMENATSAFAIQILKTCTKMANITVKRPRRIHLPATKASPSSPGRQDSDEDDGPQRVEEVDQGRGYDGDSSSGSGRSWDERSRRPRPGRRGRAGSHGRRSPGGGSEANGLALVSGFKRLPRQDVQMKPVKSVLVKRRDSEEFGVKLGSQIFIKHITDSGLAARHRGLQEGDLILQINGVSSQNLSLNDTRRLIEKSEGKLSLLVLRDRGQFLVNIPPAVSDSDSSPLEDISDLASELSQAPPSHIPPPPRHAQRSPEASQTDSPVESPRLRRESSVDSRTISEPDEQRSELPRESSYDIYRVPSSQSMEDRGYSPDTRVVRFLKGKSIGLRLAGGNDVGIFVSGVQAGSPADGQGIQEGDQILQVNDVPFQNLTREEAVQFLLGLPPGEEMELVTQRKQDIFWKMVQSRVGDSFYIRTHFELEPSPPSGLGFTRGDVFHVLDTLHPGPGQSHARGGHWLAVRMGRDLREQERGIIPNQSRAEQLASLEAAQRAVGVGPGSSAGSNARAEFWRLRGLRRGAKKTTQRSREDLSALTRQGRYPPYERVVLREASFKRPVVILGPVADIAMQKLTAEMPDQFEIAETVSRTDSPSKIIKLDTVRVIAEKDKHALLDVTPSAIERLNYVQYYPIVVFFIPESRPALKALRQWLAPASRRSTRRLYAQAQKLRKHSSHLFTATIPLNGTSDTWYQELKAIIREQQTRPIWTAEDQLDGSLEDNLDLPHHGLADSSADLSCDSRVNSDYETDGEGGAYTDGEGYTDGEGGPYTDVDDEPPAPALARSSEPVQADESQSPRDRGRISAHQGAQVDSRHPQGQWRQDSMRTYEREALKKKFTRVHDAESSDEDGYDWGPATDL

SEQ ID NO: 853300 - protein, 376 aa, Homo sapiens
CIVQLCYYVQEGRVNHVDYCTVHELMIATTNAECWSVGRCCLKTTQRSREDLSALTRQGRYPPYERVVLREASFKRPVVILGPVADIAMQKLTAEMPDQFEIAETVSRTDSPSKIIKLDTVRVIAEKDKHALLDVTPSAIERLNYVQYYPIVVFFIPESRPALKALRQWLAPASRRSTRRLYAQAQKLRKHSSHLFTATIPLNGTSDTWYQELKAIIREQQTRPIWTAEDQLDGSLEDNLDLPHHGLADSSADLSCDSRVNSDYETDGEGGAYTDGEGYTDGEGGPYTDVDDEPPAPALARSSEPVQADESQSPRDRGRISAHQGAQVDSRHPQGQWRQDSMRTYEREALKKKFTRVHDAESSDEDGYDWGPATDL

SEQ ID NO: 853301 - protein, 92 aa, Homo sapiens
MSLTQSDLGSYGRHHCSPYDAIKVLGWEGPHLDCLQQENAPRHPSPESCLSFPPPPLQSLASSWAVRSSSSTLQIRAWLPGTVGCRKEISFY

SEQ ID NO: 853302 - protein, 413 aa, Homo sapiens
MLGTVKMEGHETSDWNSYYADTQEAYSSVPVSNMNSGLGSMNSMNTYMTMNTMTTSGNMTPASFNMSYANPGLGAGLSPGAVAGMPGGSAGAMNSMTAAGVTAMGTALSPSGMGAMGAQQAASMNGLGPYAAAMNPCMSPMAYAPSNLGRSRAGGGGDAKTFKRSYPHAKPPYSYISLITMAIQQAPSKMLTLSEIYQWIMDLFPYYRQNQQRWQNSIRHSLSFNDCFVKVARSPDKPGKGSYWTLHPDSGNMFENGCYLRRQKRFKCEKQPGAGGGGGSGSGGSGAKGGPESRKDPSGASNPSADSPLHRGVHGKTGQLEGAPAPGPGRQPPDSGPQWGDGDRGRLGVEDSSLLNCAPHKLRARGAGLCARLSPGTRLGTPRVPAAPERGPPLLLQPPVLHQQPHVLLGAAA

SEQ ID NO: 853303 - protein, 413 aa, Homo sapiens; identical to SEQ ID NO: 853302

SEQ ID NO: 853304 - protein, 153 aa, Homo sapiens
MSSSARIINRTGTAILALRLYVARQPASRQRLGDHQEPHRALSPGAGVLPRCVFQTRPKHFLAPGTGGFVWHSHAGSKREKINSKQNHTNQTVNSIIKSQQLFLFHFSCTTFPPVQKTVTLLLYSKFIVYITTKTTPNQFFSCSVYTDPQVYI

SEQ ID NO: 853305 - protein, 413 aa, Homo sapiens; identical to SEQ ID NO: 853302

SEQ ID NO: 853306 - protein, 104 aa, Homo sapiens
VYLTGPPQDSRRRLTPPSAPKAEILTKLFPATKTSIPFVSNQTVNSIIKSQQLFLFHFSCTTFPPVQKTVTLLLYSKFIVYITTKTTPNQFFSCSVYTDPQVYI

SEQ ID NO: 853307 - protein, 99 aa, Homo sapiens
MNSGLGSMNSMNTYMTMNTMTTSGNMTPASFNMSYANPGLGAGLSPGAVAGMPGGSAGAMNSMTAAGVTAMGTALSPSGMGAMGAQQAASMNGLGPYAA

SEQ ID NO: 853308 - protein, 893 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 853309 - protein, 893 aa, Homo sapiens; identical to SEQ ID NO: 853308

SEQ ID NO: 853310 - protein, 893 aa, Homo sapiens; identical to SEQ ID NO: 853308

SEQ ID NO: 853311 - protein, 545 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARPSSFQCQTL

SEQ ID NO: 853312 - protein, 893 aa, Homo sapiens; identical to SEQ ID NO: 853308

SEQ ID NO: 853313 - protein, 943 aa, Homo sapiens
FLMISWDCRDVTNGDAEDVMIPRAPIPCISIVDCTTKSRRVRCGGRGKDATLRESYRLKGRLLLLVPPVCTNEMEQIHLTTDSDSTCNELVTETHMEFIVCMTPEWSLVCLILNCVTSGYSCVISSLLYLQIIHWHDTNEYTHFTRTCNRIGQVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 853314 - protein, 736 aa, Homo sapiens
MTYLILDQQRRRSNTIDKCRPIGQWLTPVIPALCQGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 853315 - protein, 487 aa, Homo sapiens
MLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 853316 - protein, 706 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKIWNWSMPGPSWSWR

SEQ ID NO: 853317 - protein, 359 aa, Homo sapiens
SFPILGLFVHRHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 853318 - protein, 415 aa, Homo sapiens
RLELVPSDKEAKHEAQRLEQEARGRLERQKILDQSEAEKARKELLELEALSMAVESTGTAKAEAESRAEAARIEGEGSVLPKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 853319 - protein, 674 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAK

SEQ ID NO: 853320 - protein, 665 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 853321 - protein, 403 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKLKRQLS

SEQ ID NO: 853322 - protein, 317 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGTHPRSVIRPARSMESNLCTSLLARS

SEQ ID NO: 853323 - protein, 280 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEVASGPSPGEGISPQSAQAPQAPGDNHVVPVLR

SEQ ID NO: 853324 - protein, 321 aa, Homo sapiens
SFPILGLFVHRHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVKLLQSLGLKSTLITDGSTPINLFNTAFGLLGMGPEGQPLGRRVASGPSPGEGISPQSAQAPQAPGDNHVVPVLR

SEQ ID NO: 853325 - protein, 106 aa, Homo sapiens
ACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKSK

SEQ ID NO: 853326 - protein, 893 aa, Homo sapiens; identical to SEQ ID NO: 853308

SEQ ID NO: 853327 - protein, 112 aa, Homo sapiens
SSSRCRGIAQRGAQSPPPIFPKGGGGHPLLWTGPEMQVKLLQSLGLKSTLITDGSTPINLFNTAFGLLGMGPEGQPLGRRVASGPSPGEGISPQSAQAPQAPGDNHVVPVLR

SEQ ID NO: 853328 - protein, 893 aa, Homo sapiens; identical to SEQ ID NO: 853308

SEQ ID NO: 853329 - protein, 893 aa, Homo sapiens; identical to SEQ ID NO: 853308

SEQ ID NO: 853330 - protein, 891 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVALS

SEQ ID NO: 853331 - protein, 841 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQKTAPVPGPFNASGPYNASGYITT

SEQ ID NO: 853332 - protein, 893 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETSQLKTEELELNKEYGRYAEWGLGVENLGKRRAPVDGPAQAPGPGCVIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 853333 - protein, 718 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSWLRWR

SEQ ID NO: 853334 - protein, 561 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETGPA

SEQ ID NO: 853335 - protein, 665 aa, Homo sapiens; identical to SEQ ID NO: 853320

SEQ ID NO: 853336 - protein, 357 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVKLLQSLGLKSTLITDGSTPINLFNTAFGLLGMGPEGQPLGRRVASGPSPGEGISPQSAQAPQAPGDNHVVPVLR

SEQ ID NO: 853337 - protein, 272 aa, Homo sapiens
MVEAGVDLDEGLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKIWNWSMPGPSWSWR

SEQ ID NO: 853338 - protein, 42 aa, Homo sapiens
MRMVTVPPRHYCTVANPVSRDAQGLVLFDVTGQVRLRHADLE

SEQ ID NO: 853339 - protein, 729 aa, Homo sapiens
MSGQPPPPPPQQQQQQQQLSPPPPAALAPVSGVVLPAPPAVSAGSSPAGSPGGGAGGEGLGAAAAALLLHPPPPPPPATAAPPPPPPPPPPPASAAAPASGPPAPPGLAAGPGPAGGAPTPALVAGSSAAAPFPHGDSALNEQEKELQRRLKRLYPAVDEQETPLPRSWSPKDKFSYIGLSQNNLRVHYKGHGKTPKDAASVRATHPIPAACGIYYFEVKIVSKGRDGYMGIGLSAQGVNMNRLPGWDKHSYGYHGDDGHSFCSSGTGQPYGPTFTTGDVIGCCVNLINNTCFYTKNGHSLGIAFTDLPPNLYPTVGLQTPGEVVDANFGQHPFVFDIEDYMREWRTKIQAQIDRFPIGDREGEWQTMIQKMVSSYLVHHGYCATAEAFARSTDQTVLEELASIKNRQRIQKLVLAGRMGEAIETTQQLYPSLLERNPNLLFTLKVRQFIEMVNGTDSEVRCLGGRSPKSQDSYPVSPRPFSSPSMSPSHGMNIHNLASGKGSTAHFSGFESCSNGVISNKAHQSYCHSNKHQSSNLNVPELNSINMSRSQQVNNFTSNDVDMETDHYSNGVGETSSNGFLNGSSKHDHEMEDCDTEMEVDSSQLRRQLCGGSQAAIERMIHFGRELQAMSEQLRRDCGKNTANKKMLKDAFSLLAYSDPWNSPVGNQLDPIQREPVCSALNSAILETHNLPKQPPLALAMGQATQCLGLMARSGIGSCAFATVEDYLH

SEQ ID NO: 853340 - protein, 729 aa, Homo sapiens; identical to SEQ ID NO: 853339

SEQ ID NO: 853341 - protein, 310 aa, Homo sapiens
MSGQPPPPPPQQQQQQQQLSPPPPAALAPVSGVVLPAPPAVSAGSSPAGSPGGGAGGEGLGAAAAALLLHPPPPPPPATAAPPPPPPPPPPPASAAAPASGPPAPPGLAAGPGPAGGAPTPALVAGSSAAAPFPHGDSALNEQEKELQRRLKRLYPAVDEQETPLPRSWSPKDKFSYIGLSQNNLRVHYKGHGKTPKDAASVRATHPIPAACGIYYFEVSVNMNRLPGWDKHSYGYHGDDGHSFCSSGTGQPYGPTFTTGDVIGCCVNLINNTCFYTKNGHSLAKFVSYCGASNTRRSGRCQFWATSFRV

SEQ ID NO: 853342 - protein, 436 aa, Homo sapiens
MPLFFFFLGIAFTDLPPNLYPTVGLQTPGEVVDANFGQHPFVFDIEDYMREWRTKIQAQIDRFPIGDREGEWQTMIQKMVSSYLVHHGYCATAEAFARSTDQTVLEELASIKNRQRIQKLVLAGRMGEAIETTQQLYPSLLERNPNLLFTLKVRQFIEMVNGTDSEVRCLGGRSPKSQDSYPVSPRPFSSPSMSPSHGMNIHNLASGKGSTAHFSGFESCSNGVISNKAHQSYCHSNKHQSSNLNVPELNSINMSRSQQVNNFTSNDVDMETDHYSNGVGETSSNGFLNGSSKHDHEMEDCDTEMEVDSSQLRRQLCGGSQAAIERMIHFGRELQAMSEQLRRDCGKNTANKKMLKDAFSLLAYSDPWNSPVGNQLDPIQREPVCSALNSAILETHNLPKQPPLALAMGQATQCLGLMARSGIGSCAFATVEDYLH

SEQ ID NO: 853343 - protein, 658 aa, Homo sapiens
MSGQPPPPPPQQQQQQQQLSPPPPAALAPVSGVVLPAPPAVSAGSSPAGSPGGGAGGEGLGAAAAALLLHPPPPPPPATAAPPPPPPPPPPPASAAAPASGPPAPPGLAAGPGPAGGAPTPALVAGSSAAAPFPHGDSALNEQEKELQRRLKRLYPAVDEQETPLPRSWSPKDKFSYIGLSQNNLRVHYKGHGKTPKDAASVRATHPIPAACGIYYFEVKIVSKGRDGYMGIGLSAQGVNMNRLPGWDKHSYGYHGDDGHSFCSSGTGQPYGPTFTTGDVIGCCVNLINNTCFYTKNGHSLGIAFTDLPPNLYPTVGLQTPGEVVDANFGQHPFVFDIEDYMREWRTKIQAQIDRFPIGDREGEWQTMIQKMVSSYLVHHGYCATAEAFARSTDQTVLEELASIKNRQRIQKLVLAGRMGEAIETTQQLYPSLLERNPNLLFTLKVRQFIEMVNGTDSEVRCLGGRSPKSQDSYPVSPRPFSSPSMSPSHGMNIHNLASGKGSTAHFSGFESCSNGVISNKAHQSYCHSNKHQSSNLNVPELNSINMSRSQQVNNFTSNDVDMETDHYSNGVGETSSNGFLNGSSKHDHEMEDCDTEMEVDSSQLRRQLCGGSQAAIERMIHFGRELQAMSEQLRRDCGKNTANKKMLKVNIFFLEKL

SEQ ID NO: 853344 - protein, 601 aa, Homo sapiens
MSGQPPPPPPQQQQQQQQLSPPPPAALAPVSGVVLPAPPAVSAGSSPAGSPGGGAGGEGLGAAAAALLLHPPPPPPPATAAPPPPPPPPPPPASAAAPASGPPAPPGLAAGPGPAGGAPTPALVAGSSAAAPFPHGDSALNEQEKELQRRLKRLYPAVDEQETPLPRSWSPKDKFSYIGLSQNNLRVHYKGHGKTPKDAASVRATHPIPAACGIYYFEVKIVSKGRDGYMGIGLSAQGVNMNRLPGWDKHSYGYHGDDGHSFCSSGTGQPYGPTFTTGDVIGCCVNLINNTCFYTKNGHSLGIAFTDLPPNLYPTVGLQTPGEVVDANFGQHPFVFDIEDYMREWRTKIQAQIDRFPIGDREGEWQTMIQKMVSSYLVHHGYCATAEAFARSTDQTVLEELASIKNRQRIQKLVLAGRMGEAIETTQQLYPSLLERNPNLLFTLKVRQFIEMVNGTDSEVRCLGGRSPKSQDSYPVSPRPFSSPSMSPSHGMNIHNLASGKGSTAHFSGFESCSNGVISNKAHQSYCHSNKHQSSNLNVPELNSINMSRSQQVNNFTSNDVDMETDHYSNGVGETSSNGFLNGSSKHDHEMEDCDTEMGLQ

SEQ ID NO: 853345 - protein, 329 aa, Homo sapiens
MSGQPPPPPPQQQQQQQQLSPPPPAALAPVSGVVLPAPPAVSAGSSPAGSPGGGAGGEGLGAAAAALLLHPPPPPPPATAAPPPPPPPPPPPASAAAPASGPPAPPGLAAGPGPAGGAPTPALVAGSSAAAPFPHGDSALNEQEKELQRRLKRLYPAVDEQETPLPRSWSPKDKFSYIGLSQNNLRVHYKGHGKTPKDAASVRATHPIPAACGIYYFEVKIVSKGRDGYMGIGLSAQGVNMNRLPGWDKHSYGYHGDDGHSFCSSGTGQPYGPTFTTGDVIGCCVNLINNTCFYTKNGHSLVASLTYRNCILLWLNTRRVAMPFGTPTS

SEQ ID NO: 853346 - protein, 328 aa, Homo sapiens
MSGQPPPPPPQQQQQQQQLSPPPPAALAPVSGVVLPAPPAVSAGSSPAGSPGGGAGGEGLGAAAAALLLHPPPPPPPATAAPPPPPPPPPPPASAAAPASGPPAPPGLAAGPGPAGGAPTPALVAGSSAAAPFPHGDSALNEQEKELQRRLKRLYPAVDEQETPLPRSWSPKDKFSYIGLSQNNLRVHYKGHGKTPKDAASVRATHPIPAACGIYYFEVKIVSKGRDGYMGIGLSAQGVNMNRLPGWDKHSYGYHGDDGHSFCSSGTGQPYGPTFTTGDVIGCCVNLINNTCFYTKNGHSLAKFVSYCGASNTRRSGRCQFWATSFRV

SEQ ID NO: 853347 - protein, 312 aa, Homo sapiens
MSGQPPPPPPQQQQQQQQLSPPPPAALAPVSGVVLPAPPAVSAGSSPAGSPGGGAGGEGLGAAAAALLLHPPPPPPPATAAPPPPPPPPPPPASAAAPASGPPAPPGLAAGPGPAGGAPTPALVAGSSAAAPFPHGDSALNEQEKELQRRLKRLYPAVDEQETPLPRSWSPKDKFSYIGLSQNNLRVHYKGHGKTPKDAASVRATHPIPAACGIYYFEVKIVSKGRDGYMGIGLSAQGVNMNRLPGWDKHSYGYHGDDGHSFCSSGTGQPYGPTFTTGDVIGCCVNLINNTCFYTKNGHSLGIAFTDLPLSC

SEQ ID NO: 853348 - protein, 167 aa, Homo sapiens [sequence omitted]

SEQ ID NO: 853349 - protein, 558 aa, Homo sapiens
MSGQPPPPPPQQQQQQQQLSPPPPAALAPVSGVVLPAPPAVSAGSSPAGSPGGGAGGEGLGAAAAALLLHPPPPPPPATAAPPPPPPPPPPPASAAAPASGPPAPPGLAAGPGPAGGAPTPALVAGSSAAAPFPHGDSALNEQEKELQRRLKRLYPAVDEQETPLPRSWSPKDKFSYIGLSQNNLRVHYKGHGKTPKDAASVRATHPIPAACGIYYFEVKIVSKGRDGYMGIGLSAQGVNMNRLPGWDKHSYGYHGDDGHSFCSSGTGQPYGPTFTTGDVIGCCVNLINNTCFYTKNGHSLGIAFTDLPPNLYPTVGLQTPGEVVDANFGQHPFVFDIEDYMREWRTKIQAQIDRFPIGDREGEWQTMIQKMVSSYLVHHGYCATAEAFARSTDQTVLEELASIKNRQRIQKLVLAGRMGEAIETTQQLYPSLLERNPNLLFTLKVRQFIEMVNGTDSEVRCLGGRSPKSQDSYPVSPRPFSSPSMSPSHGMNIHNLASGKGSTAHFSGFESCSNGVISNKAHQSYCHSNKHQSSNLNVPELNSINMSRSQQVNNFTR

SEQ ID NO: 853350 - protein, 69 aa, Homo sapiens
LMKYAILPNLYPTVGLQTPGEVVDANFGQHPFVFDIEDYMREWRTKIQAQIDRFPIGDREGEWQTMIQK

SEQ ID NO: 853351 - protein, 69 aa, Homo sapiens
RPQRLSCCWSALGSAPARPPVHTRGSRPGRPLGGDCGCAAGKGPGRSRRRDWGAAPPSLQTVMVMSGSV

SEQ ID NO: 853352 - protein, 129 aa, Homo sapiens
MQRADSEQPSKRPRCDDSPRTPSNTPSAEADWSPGLELHPDYKTWGPEQVCSFLRRGGFEEPVLLKNIRENEITGALLPCLDESRFENLGVSSLGERKKLLSYIQRLVQIHVDTMKGGVSSRMSSSRTG

SEQ ID NO: 853353 - protein, 626 aa, Homo sapiens
MQRADSEQPSKRPRCDDSPRTPSNTPSAEADWSPGLELHPDYKTWGPEQVCSFLRRGGFEEPVLLKNIRENEITGALLPCLDESRFENLGVSSLGERKKLLSYIQRLVQIHVDTMKVINDPIHGHIELHPLLVRIIDTPQFQRLRYIKQLGGGYYVFPGASHNRFEHSLGVGYLAGCLVHALGEKQPELQISERDVLCVQIAGLCHDLGHGPFSHMFDGRFIPLARPEVKWTHEQGSVMMFEHLINSNGIKPVMEQYGLIPEEDICFIKEQIVGPLESPVEDSLWPYKGRPENKSFLYEIVSNKRNGIDVDKWDYFARDCHHLGIQNNFDYKRFIKFARVCEVDNELRICARDKEVGNLYDMFHTRNSLHRRAYQHKVGNIIDTMITDAFLKADDYIEITGAGGKKYRISTAIDDMEAYTKLTDNIFLEILYSTDPKLKDAREILKQIEYRNLFKYVGETQPTGQIKIKREDYESLPKEVASAKPKVLLDVKLKAEDFIVDVINMDYGMQEKNPIDHVSFYCKTAPNRAIRITKNQVSQLLPEKFAEQLIRVYCKKVDRKSLYAARQYFVQWCADRNFTKPQDGDVIAPLITPQKKEWNDSTSVQNPTRLREASKSRVQLFKDDPM

SEQ ID NO: 853354 - protein, 411 aa, Homo sapiens
MFDGRFIPLARPEVKWTHEQGSVMMFEHLINSNGIKPVMEQYGLIPEEDICFIKEQIVGPLESPVEDSLWPYKGRPENKSFLYEIVSNKRNGIDVDKWDYFARDCHHLGIQNNFDYKRFIKFARVCEVDNELRICARDKEVGNLYDMFHTRNSLHRRAYQHKVGNIIDTMITDAFLKADDYIEITGAGGKKYRISTAIDDMEAYTKLTDNIFLEILYSTDPKLKDAREILKQIEYRNLFKYVGETQPTGQIKIKREDYESLPKEVASAKPKVLLDVKLKAEDFIVDVINMDYGMQEKNPIDHVSFYCKTAPNRAIRITKNQVSQLLPEKFAEQLIRVYCKKVDRKSLYAARQYFVQWCADRNFTKPQDGDVIAPLITPQKKEWNDSTSVQNPTRLREASKSRVQLFKDDPM

SEQ ID NO: 853355 - protein, 551 aa, Homo sapiens
NQLGTVLMSLVLKILEYSLGERKKLLSYIQRLVQIHVDTMKVINDPIHGHIELHPLLVRIIDTPQFQRLRYIKQLGGGYYVFPGASHNRFEHSLGVGYLAGCLVHALGEKQPELQISERDVLCVQIAGLCHDLGHGPFSHMFDGRFIPLARPEVKWTHEQGSVMMFEHLINSNGIKPVMEQYGLIPEEDICFIKEQIVGPLESPVEDSLWPYKGRPENKSFLYEIVSNKRNGIDVDKWDYFARDCHHLGIQNNFDYKRFIKFARVCEVDNELRICARDKEVGNLYDMFHTRNSLHRRAYQHKVGNIIDTMITDAFLKADDYIEITGAGGKKYRISTAIDDMEAYTKLTDNIFLEILYSTDPKLKDAREILKQIEYRNLFKYVGETQPTGQIKIKREDYESLPKEVASAKPKVLLDVKLKAEDFIVDVINMDYGMQEKNPIDHVSFYCKTAPNRAIRITKNQVSQLLPEKFAEQLIRVYCKKVDRKSLYAARQYFVQWCADRNFTKPQDGDVIAPLITPQKKEWNDSTSVQNPTRLREASKSRVQLFKDDPM

SEQ ID NO: 853356 - protein, 265 aa, Homo sapiens [sequence omitted]

SEQ ID NO: 853357 - protein, 586 aa, Homo sapiens
MQRADSEQPSKRPRCDDSPRTPSNTPSAEADWSPGLELHPDYKTWGPEQVCSFLRRGGFEEPVLLKNIRENEITGALLPCLDESRFENLGVSSLGERKKLLSYIQRLVQIHVDTMKVINDPIHGHIELHPLLVRIIDTPQFQRLRYIKQLGGGYYVFPGASHNRFEHSLGVGYLAGCLVHALGEKQPELQISERDVLCVQIAGLCHDLGHGPFSHMFDGRFIPLARPEVKWTHEQGSVMMFEHLINSNGIKPVMEQYGLIPEEDICFIKEQIVGPLESPVEDSLWPYKGRPENKSFLYEIVSNKRNGIDVDKWDYFARDCHHLGIQNNFDYKRFIKFARVCEVDNELRICARDKEVGNLYDMFHTRNSLHRRAYQHKVGNIIDTMITDAFLKADDYIEITGAGGKKYRISTAIDDMEAYTKLTDNIFLEILYSTDPKLKDAREILKQIEYRNLFKYVGETQPTGQIKIKREDYESLPKEVASAKPKVLLDVKLKAEDFIVDVINMDYGMQEKNPIDHVSFYCKTAPNRAIRITKNQVSQLLPEKFAEQLIRVYCKKVDRKSLYAARQYFVQWCADRNFTKPQMAML

SEQ ID NO: 853358 - protein, 478 aa, Homo sapiens [sequence omitted]

SEQ ID NO: 853359 - protein, 170 aa, Homo sapiens
MQRADSEQPSKRPRCDDSPRTPSNTPSAEADWSPGLELHPDYKTWGPEQVCSFLRRGGFEEPVLLKNIRENEITGALLPCLDESRFENLGVSSLGERKKLLSYIQRLVQIHVDTMKVINDPIHGHIELHPLLVRIIDTPQFQRLRYIKQLGGGYYVFPGASHNRFEHSLG

SEQ ID NO: 853360 - protein, 131 aa, Homo sapiens
MQRADSEQPSKRPRCDDSPRTPSNTPSAEADWSPGLELHPDYKTWGPEQVCSFLRRGGFEEPVLLKNIRENEITGALLPCLDESRFENLGVSSLGERKKLLSYIQRLVQIHVDTMKVRGSEFVMFFEYKVI

SEQ ID NO: 853361 - protein, 626 aa, Homo sapiens; identical to SEQ ID NO: 853353

SEQ ID NO: 853362 - protein, 626 aa, Homo sapiens; identical to SEQ ID NO: 853353

SEQ ID NO: 853363 - protein, 642 aa, Homo sapiens
MQRADSEQPSKRPRCDDSPRTPSNTPSAEADWSPGLELHPDYKTWGPEQVCSFLRRGGFEEPVLLKNIRENEITGALLPCLDESRFENLGVSSLGERKKLLSYIQRLVQIHVDTMKVINDPIHGHIELHPLLVRIIDTPQFQRLRYIKQLGGGYYVFPGASHNRFEHSLGVGYLAGCLVHALGEKQPELQISERDVLCVQIAGLCHDLGHGPFSHMFDGRFIPLARPEVKWTHEQGSVMMFEHLINSNGIKPVMEQYGLIPEEDICFIKEQIVGPLESPVEDSLIWCLILKLPVGFLAFQWPYKGRPENKSFLYEIVSNKRNGIDVDKWDYFARDCHHLGIQNNFDYKRFIKFARVCEVDNELRICARDKEVGNLYDMFHTRNSLHRRAYQHKVGNIIDTMITDAFLKADDYIEITGAGGKKYRISTAIDDMEAYTKLTDNIFLEILYSTDPKLKDAREILKQIEYRNLFKYVGETQPTGQIKIKREDYESLPKEVASAKPKVLLDVKLKAEDFIVDVINMDYGMQEKNPIDHVSFYCKTAPNRAIRITKNQVSQLLPEKFAEQLIRVYCKKVDRKSLYAARQYFVQWCADRNFTKPQDGDVIAPLITPQKKEWNDSTSVQNPTRLREASKSRVQLFKDDPM

SEQ ID NO: 853364 - protein, 411 aa, Homo sapiens; identical to SEQ ID NO: 853354

SEQ ID NO: 853365 - protein, 589 aa, Homo sapiens
MQRADSEQPSKRPRCDDSPRTPSNTPSAEADWSPGLELHPDYKTWGPEQVCSFLRRGGFEEPVLLKNIRENEITGALLPCLDESRFENLGVSSLGERKKLLSYIQRLVQIHVDTMKVINDPIHGHIELHPLLVRIIDTPQFQRLRYIKQLGGGYYVFPGASHNRFEHSLGVGYLAGCLVHALGEKQPELQISERDVLCVQIAGLCHDLGHGPFSHMFDGRFIPLARPEVKWTHEQGSVMMFEHLINSNGIKPVMEQYGLIPEEDICFIKEQIVGPLESPVEDSLWPYKGRPENKSFLYEIVSNKRNGIDVDKWDYFARDCHHLGIQNNFDYKRFIKFARVCEVDNELRICARDKEVGNLYDMFHTRNSLHRRAYQHKVGNIIDTMITDAFLKADDYIEITGAGGKKYRISTAIDDMEAYTKLTDNIFLEILYSTDPKLKDAREILKQIEYRNLFKYVGETQPTGQIKIKREDYESLPKEVASAKPKVLLDVKLKAEDFIVDVINMDYGMQEKNPIDHVSFYCKTAPNRAIRITKNQVSQLLPEKFAEQLIRVYCKKVDRKSLYAARQYFVQWCADRNFTKPQSPTRASH

SEQ ID NO: 853366 - protein, 598 aa, Homo sapiens
MQRADSEQPSKRPRCDDSPRTPSNTPSAEADWSPGLELHPDYKTWGPEQVCSFLRRGGFEEPVLLKNIRENEITGALLPCLDESRFENLGVSSLGERKKLLSYIQRLVQIHVDTMKVINDPIHGHIELHPLLVRIIDTPQFQRLRYIKQLGGGYYVFPGASHNRFEHSLGVGYLAGCLVHALGEKQPELQISERDVLCVQIAGLCHDLGHGPFSHMFDGRFIPLARPEVKWTHEQGSVMMFEHLINSNGIKPVMEQYGLIPEEDICFIKEQIVGPLESPVEDSLWPYKGRPENKSFLYEIVSNKRNGIDVDKWDYFARDCHHLGIQNNFDYKRFIKFARVCEVDNELRICARDKEVGNLYDMFHTRNSLHRRAYQHKVGNIIDTMITDAFLKADDYIEITGAGGKKYRISTAIDDMEAYTKLTDNIFLEILYSTDPKLKDAREILKQIEYRNLFKYVGETQPTGQIKIKREDYESLPKEVASAKPKVLLDVKLKAEDFIVDVINMDYGMQEKNPIDHVSFYCKTAPNRAIRITKNQVSQLLPEKFAEQLIRVYCKKVDRKSLYAARQYFVQWCADRNFTKPQVGGLLLTNFAQFFIFK

SEQ ID NO: 853367 - protein, 324 aa, Homo sapiens
MQRADSEQPSKRPRCDDSPRTPSNTPSAEADWSPGLELHPDYKTWGPEQVCSFLRRGGFEEPVLLKNIRENEITGALLPCLDESRFENLGVSSLGERKKLLSYIQRLVQIHVDTMKVINDPIHGHIELHPLLVRIIDTPQFQRLRYIKQLGGGYYVFPGASHNRFEHSLGVGYLAGCLVHALGEKQPELQISERDVLCVQIAGLCHDLGHGPFSHMFDGRFIPLARPEVKWTHEQGSVMMFEHLINSNGIKPVMEQYGLIPEEDICFIKEQIVGPLESPVEDSLWPYKGRPENKSFLYEIVSNKRNGIDVDKWDYFASLPVSVK

SEQ ID NO: 853368 - protein, 1907 aa, Homo sapiens
MEDRRAEKSCEQACESLKRQDYEMALKHCTEALLSLGQYSMADFTGPCPLEIERIKIESLLYRIASFLQLKNYVQADEDCRHVLGEGLAKGEDAFRAVLCCMQLKGKLQPVSTILAKSLTGESLNGMVTKDLTRLKTLLSETGFLEQGICRYGAQCTSAHSQEELAEWQKRYASRLIKLKQQNENKQLSGSYMETLIEKWMNSLSPEKVLSECIEGVKVEHNPDLSVTVSTKKSHQTWTFALTCKPARMLYRVALLYDAHRPHFSIIAISAGDSTTQVSQEVPENCQEWIGGKMAQNGLDHYVYKVGIAFNTEIFGTFRQTIVFDFGLEPVLMQRVMIDAASTEDLEYLMHAKQQLVTTAKRWDSSSKTIIDFEPNETTDLEKSLLIRYQIPLSADQLFTQSVLDKSLTKSNYQSRLHDLLYIEEIAQYKEISKFNLKVQLQILASFMLTGVSGGAKYAQNGQLFGRFKLTETLSEDTLAGRLVMTKVNAVYLLPVPKQKLVQTQGTKEKVYEATIEEKTKEYIFLRLSRECCEELNLRPDCDTQVELQFQLNRLPLCEMHYALDRIKDNGVLFPDISMTPTIPWSPNRQWDEQLDPRLNAKQKEAVLAITTPLAIQLPPVLIIGPYGTGKTFTLAQAVKHILQQQETRILICTHSNSAADLYIKDYLHPYVEAGNPQARPLRVYFRNRWVKTVHPVVHQYCLISSAHSTFQMPQKEDILKHRVVVVTLNTSQYLCQLDLEPGFFTHILLDEAAQAMECETIMPLALATQNTRIVLAGDHMQLSPFVYSEFARERNLHVSLLDRLYEHYPAEFPCRILLCENYRSHEAIINYTSELFYEGKLMASGKQPAHKDFYPLTFFTARGEDVQEKNSTAFYNNAEVFEVVERVEELRRKWPVAWGKLDDGSIGVVTPYADQVFRIRAELRKKRLSDVNVERVLNVQGKQFRVLFLSTVRTRHTCKHKQTPIKKKEQLLEDSTEDLDYGFLSNYKLLNTAITRAQSLVAVVGDPIALCSIGRCRKFWERFIALCHENSSLHGITFEQIKAQLEALELKKTYVLNPLAPEFIPRALRLQHSGSTNKQQQSPPKGKSLHHTQNDHFQNDGIVQPNPSVLIGNPIRAYTPPPPLGPHPNLGKSPSPVQRIDPHTGTSILYVPAVYGGNVVMSVPLPVPWTGYQGRFAVDPRIITHQAAMAYNMNLLQTHGRGSPIPYGLGHHPPVTIGQPQNQHQEKDQHEQNRNGKSDTNNSGPEINKIRTPEKKPTEPKQVDLESNPQNRSPESRPSVVYPSTKFPRKDNLNPRHINLPLPAPHAQYAIPNRHFHPLPQLPRPPFPIPQQHTLLNQQQNNLPEQPNQIPPQPNQVVQQQSQLNQQPQQPPPQLSPAYQAGPNNAFFNSAVAHRPQSPPAEAVIPEQQPPPMLQEGHSPLRAIAQPGPILPSHLNSFIDENPSGLPIGEALDRIHGSVALETLRQQQARFQQWSEHHAFLSQGSVPYPHHHHPHLQHLPQPPLGLHQPPVRADWKLTSSAEDEVETTYSRFQDLIRELSHRDQSETRELAEMPPPQSRLLQYRQVQSRSPPAVPSPPSSTDHSSHFSNFNDNSRDIEVASNPAFPQRLPPQIFNSPFSLPSEHLAPPPLKYLAPDGAWTFANLQQNHLMGPGFPYGLPPLPHRPPQNPFVQIQNHQHAIGQEPFHPLSSRTVSSSSLPSLEEYEPRGPGRPLYQRRISSSSVQPCSEEVSTPQDSLAQCKELQDHSNQSSFNFSSPESWVNTTSSTPYQNIPCNGSSRTAQPRELIAPPKTVKPPEDQLKSENLEVSSSFNYSVLQHLGQFPPLMPNKQIAESANSSSPQSSAGGKPAMSYASALRAPPKPRPPPEQAKKSSDPLSLFQELSFPSRENVLISVCISRIKVVGLHL
